United States Patent 8,781,750 (CELL-TYPE-SPECIFIC PATTERNS OF GENE EXPRESSION) - sequence listing, part 33

SEQ ID NO: 37247 - DNA, 369560 bp, Homo sapiens
aagagggaggggtctgtgcgcccgcagagtcgccaggcgccctgcgagttgtctccgctgggaggggcgaggctgtcacttgccagggcgcgaggagcctcagcgcggcttggagaacttggccccgcgcagcgtctggtcactcgctctcctctggggactgcagagaagcaggacctcgggccatgggtgagtgcgcgggcgggcgcgtacacctcgcccaaaggctcggcctcgggaatgggcattatagaaagaaaatgaatgttcctcggcctcagactgcgtccttcccagctctgttccccccgcgcctggcgtcccccgccccccgccctcttgtctccggacttttttttctgggagagaggcgatggcgatggggtggcacctggaggcgagggagggtgcccgactgtttacagtgggtcgggagggtggggggctgcgcttgggcgctgatcctctgcgccggccccaggacccaagcctgggggtccggtctaccgtgctgggggcggtatttgggaaataaagaaagactaagagacccaggatccgaatagcgaggcgattacagggagatctctgtcctcccgagttcccacgttttcatgttctctttggggagcaagttgaaacggggcacgagaaatggaaacttcctaaaacttccactttgtacaggtttgagcagaggaaggtgctggtgcagggccagactggggacaatttctagtccctttccaaacgaagtgcccatttgcacaaaaggtttgaggttgaggctgaaggctgattcttcctaaattccacctgggtaaacagcgtgattaaaagggcgtccacactggctcgggtcactggacggtggagttcggcgcagttcagcttcgctcaagtttccaggcagggtccgcttattcggtgcttagcggaggcagcttggaatagctccaggaatgtgactgcgtgtggcggaggggaggaagaactgggtgtgaaatagccgattcacacccagcactaggacgcagggtcccacgagtcacctcgaagagcgagggagaagctggggaggagaaagcactcgccatccctggactggcgtatccacaggcgcaggggagatgctgctcttccgcggttgccgactgcgttcagcccgcagcccgagttactcttccaaccccagcccgctcacttcttccagccaagtccactgggcgcccctcccccttgcttctcccttgtcctttgttgtgagggatttctccaagagtaaaggaggccttggggactgacgtgctcgggttgaaattcctgtattcccacaggctcaagggttaggggatgctttgactactaatttctggagtttatagacagtagccaacttggaagaaaggaaaaaagagaaagctgaggacatttttgcctatgaatgttagctgtgatcaagactttcatagtctcttcttgcttgacccctggaagtgtcttagaaggacccatttttagggcctttgtataaacagtgttggaaatggtcttaagaaggactgtctttaaatgttttctgaaaaggaaggagtattttcaggttaaaaaagaaagataaaacattttcccaagtgtggcagagagtatttcaggctcttttttttatttggttgttaagtgttgtgttccattggaaagacaggtccggaatattttaaatttttctcctaaacccaacacttgctgttctacttgaccacttgagcctataaactcttgtttctatgctcacacaggagaaaagctgtcagaaatggaaagtcaaaataattgacttgatgtagtctattcattagctgtattaaaagcattaaaatgccatttggatccaacataataaaatgtctagaaagaattacataatttacccttgtaacctcaagctcgagaggactggctatcaaaggtaaggtattcataatttcaaacttaattatttttaatttccatttccttactatagtgaaaacaatttgtcctggattttgcttcaatgcccatggataattaacaatcatccctaattataggaagattttgttgtgggggatggtgtggagttaacagctgagttgtcaggatccaaagcttggtctgtaactcttagaagttctctttcctgtctgtaatctgacagatacctaaaatttgtttgttccttctactgccagaagtggataacatttttcctgttgtaattgaggtcaccaaaaacttacgtagtcaggggcctagtaggacagattaaaaatattcctgaactctctttagatggaagtagaggaagcaagtgaggaagccagaggtgagcgaaatagagaaaagagcaggcctgtagcaggggagagtgacagcatgaagccagaactcaggacagagattcaagtatgcagtccagagactaggaagagccaataagaggggcaaagtggggaaagcaggaaggaagtgcataggggaaatagaaaacatttggccacttaaggccatatctctcctctttcttttaatttacttatgaaaaataaaacttcactactcagaacctcttctatttagtggtagtagggatggtagggagtttagcattagagtccaaatggctaggataagagggaaaaacagcgtaggagaatgctggattgcgccaacaaatggaatccagtttttttgttttgttttgtttttgtttttttcctggtatcatgaaaaccaaaatttatcacttaaagaaaggaagatagtgttctggggatgaatgtagcaatcaattctcatttgtcttagaagaagaaatctgaactctagcactgtggaagaatgagagtaattggttaatcaaacattctgaataatttatagtccttcatatccataatgcacaaggctgattgtaaaaaaaaaaaaaagttatttgcaaagtaggcaaattgcaattttggcatctcttccttttattgtttgatttcctcattgatgtcctcggcttctctaggtatgcagcagggctatccctccactgcaaaatttcactctgcagaaaggatgcaacaaaatagttgatactaaaaaaactgcagggctaacacattgctaagagtatttacattttaactttaagatgaactttaacctgcgaatctctaattgtggaatttcaggccccattggaaagataggtcaggaatatttttacattttctcctgaacacaacacttactgttctacttgactacatgtatatcactatgagactacatgtatatcactatgagaccattgattactgttttgtttaaaaatgatgttgaatatgatttagtttgacagatattatgaaaagtttaatgggagtggtactgaacctgtcttggaggaatgtgaaacatttggaaaggaagtggttctaggtagaataaggagctccttctcatggcagtaaggaggtgtgtttggggaacagtaagacatggagctggattgacaggatgggatttgattttggagagcttttaaaagcaatgataggaggtagggtgtcatggaaggtttttgagcagggaagacataatgagattagtgaaaatgttgtttaaaacagaattagttggagaagacagatccagttgtcacagtaatcctgggataatatgatatatgcctaaaccagtttgggaataatattatatgatatatatgatatgataataatagaatatgatacatgtctaagccagtggaaccggagagcaaaagattgatgagagataggtcaagtgaaaaatctataaaattaggaaatggagcaataagagaatgaatagaagattttgtctagaaatttgaaatcttgaagactggggaagcagtgggttccttgatagaatatttaaaggataaacccaatggtttactttctgcatgttttggacaagaaattaatttcatatttgaaatgttattaagaagtgatagcaaggccgggtgcggtggctcacgcctgtaatctcagcactttgagaggcaggacgagctgggtggatcagttgaagccaggtgtttgagaccaacctgagcaacatagtgagaccgtctctactaaaattacaaacagtagccgggtgtggtggcacacgcctgtaatcccagctactcgggaagctgaagcacgagaatcgcttgaacccatgaggcagaggttgcagtgagccgagatcatgccactacactccagcctggacaacagagagagactcagtctcaaacaaaaaggaaaaaaaaaaagaggtaatagcaagacatctaaacacaaatatttagtatgttaggaacacataatgagaatttaatcagaacacaggaacaaaaaggaaaacaaagatgaaagggttaccaacctttagtgagaggaaaacccatgaaatgaattatctatttgaaagtgtgagtataaggagtactggttgagggacagggagggaaaggataaatcctgtttgattgaagaaggatgccaactgcatgatacgtactaaatgccccaacataagaacagtgaaatgtgacaacttaaacattccacattagatttaagagtatacacattttgacaagagaaaaatatccaatggaaatattttgctcttactcaatttgagtaacaatggagttggttaagtatctgtaaaattgtttgcaaatttagacaaaaaataatgacacacagtattgtcttgagctcataccttttttttcaggaaaactatgacaccctcgagacagttatgaacaaggtacaagagccaaggtttgaaataggagaagcagatgataatcccttatgcctttgaatgggtcctataaatctctgggatcctgtttcctcatttgtttgatgagaaggttgggcaaggttctataaatttatgtagctcagctcttgatccagtaactattagagaaaaaaaaaacatgtaaagaagataagattaagctatttccattaagcaaatcaagaacacttttatgatgctagagtactggataatacttttgatcatttggcttctagtgtgttattttccttagaaaatcacaaagtctgataagagtcccaacctcagcggaagaagataaaagtcatgttctaagcatttattgctgcataaaatgatctcccaaactagtggattaaaacaacaatttattattttcattcacggttctgagggctgactgtctgctgagcaatcctcatttgaagtctcctgccttggaagcctgatgacagcaggggattcagccatctgaagacaggattggactggtcgtccaagagagctcacatatatatagctggcagttgatgccagctgttgactacgagtttatctcgggctgtcctgaagtggcttgggttttccacaaaatggtggctaggtttcaagaggcagcatcccaagaatgaatgttccaaaaaacccaagcagaagctgcaaagattcttatgatctagcatcagaaatcccaggacatcgcttttccttgatgtgaggagcagccagctcatacgaggaaaggagaaattgagggtagccgactaattgatctaattcctaaaagagctgtcttgttaagtgtgcttcacattgggtttacaactgaaaactcagcacaagtcctgagaaaaacatgattaaagactaaatttttaattagaaacatgaagaaatctaaacagtcacactaaaatttcacagcaaaacatttgagtgtggaaattcatgcctgggtggaaatgtgttggtagaatactgggataagctccactcaaaatagtttcaaataaaatcagctaatcttccttattttcccttgagtctgaagtttctaaggctattgtagggtactgttcattttatttagagtggagttggtcataaactggaatgtaggtcaattagcataaatcctttgctcaatatcctcttgtcacaatcaactagatgctttgtagtgaactgtttaggagcttgctttatttttcaagaatgtgttagctttacaaagtacaaaatttgaattggtatagtgtcactaggggtttcaccatacttttcttttgaagagatgtatttaactaaggttccacttaacaaaactcttcatgtaaatctccttttattattaatacttttatctggcaaagttagagctgtctctgtgattacaaaaaatcgaggcctttctcccagacatttgaaaaacaaagaaaaattagggtaaatgagatgggttgaaactccaggacagagttagtttcaacctagaaattttagaggccttaaaaaatattagctcattattgtgtttcagcttatttaagttgaggtcattctattttcaactgtttgacaagaggtgaggagacaagggtaaatactgcaaagctgtgtactcaatgctcactatccatgctatagcaagcaaacaaagccacatcccaatgagaaatgaagccttgacctgtatgaacgacataaccagaataatggaataatgcgttaattctagaaagcagtatgataaaacaaattctttttcagtttaagatattcgctatttattttaagatatataaggtatgcttaaataatatacagtaataacaaaataaatatctcttgctagttgtataaactttcttattgtagaacctctaattttattgcctagctaaaataccttaaagcatatattaaatactgattcctgggtcccaactcccaagactcagattcagaaggcttgggcttgagagctggacctgcaattttaacatgtaatccgactgatgatgaggcaggaagtctggggcatgcaacgagaaaaactgactccagaatgcctttctttcaagctgacttagccactcattacagctgttattccttcacttgtatcgctaatcgctaatatacaggcgtaccctgtcttgttgcacttcactgtattgtgcttcgtagatactgtgctttttttttttttttttttttttacaaattgaaaggatcaagcagcaatttccacttccaagtcttattatttaagaactatatctcacaaggcaatagctgccatacatagtgattcctctaatggatctggacaaagtcaattgaaaaccttctggaaagaatttaccattctagatgcccttaagaacattcacgattcataggaggagatcaaatatcagtattaataggagtttggaatagattgattccagtcttcatggataaccttgaggggctcaagccttcagtggaggaagtaactgcagatgtggtagaaatagcaagagaactagaattagaagtggagcctgaagatgtgactgaattgctgcaatgtcatgatgaaacttgaatggatgagaagttgctttctatggatgaataatgaaagtggttccttaaaatggaatttacttctggtaaagatgcagtgatattgttgaaatgacaacaaaggttctagagtattacataaacttagttgataaagcagcggtaggatttactccaattttgaaagttctactatgagtaaaatgctaaccaacagcatcacatgctacagagaaatctttcatgaaaggaagagtcagttgatgcagcaattatattgccttaaaataagacaaatgcaattcattatcttattgtaagaaattgcccaaccaccttcagcaaccaccaccctgatcagtcagcagccgtcaacagggaggcaaggccctccaccagcaaaaagattatgacttgctgaaggctcagattattataagcatttttctagcaataaagtattttaaaattaaggtatatacattgggttttttttagacataatgctattgcacactttatagaatttagcatagtgtaaacataacttttatatgcactgggaaatcaaaaaattcatgtgacttgctttattgtgatgttggctttattgcagttgtttagaatgcaaccccaaatacctctaaggcatgcctgcactatttttattttctaatcctggtcctaatattaccaagagctacctcttggaattactattacatttctgtttcatttcactactaaacttactaagtttctatagttgctgtctcttctttttcatcagtcactaatcagccttcttgggtgatgttctccagagttcactgaaacccctcccctgaaagttactaataacctcctgtctcatagcttcagtgtcatttgtatttatgtatctctcaaatgcatatctatgcctgtcagctgtcttcacctagctgtccctttggtccttcagcctcaataggttcaaaactctcctttctctctatcttggaaagatgtttgtagaaaataagggaaattggaaaaggaatgtgaacataataaatatttcatatattattacatttgtacacgttgctaggaaaatctggtaaagctacaagtaagttgcacaaatgcctggagttcagtaaatactgcgtctgatgaaagtctacctttcttttatgtctctctgtgtctggtatgtcagctgcttcctccttgcattatagttatttgtgaatgtgtattgtttccttcattatttggggtcatgtccagactttgaaggcaacaacatttagataattgacaaagaaaccaacaaatactcttatcatcaagctatttgcctatgactgcctactttgctaactcagaaagatacaaaaatacaaaatttaaaaagtataatgtatttaatattggtcattgcaggagacaggaaagaaggcaaaactgtggaatgagtgtatctgttcagaacagggtatagaaaacagttgtgggagggagttaaccttagaccaaaggcccttgtgaaagaaacactaaggcaagaaggatctagaacattaaggcaagaaggacttttcagctgaaaagtagatgagacagagttagtgcacattcagaagaatcaaagaaaaaaaaagagttttaagaagtgagtgacctacagtattcagtgcaacagaaagaacagaaaggaatacaatatattttgttttaagggttttttcatttatatcagatattgaaatcaaagcatttttaataaaggagtgaagatacaagtctgctctcatagaccagattacaaggactaggaaaaaaaaaaaagaaaggaagaaaagtaaggaagaaagaggggagggagagaggggagggaaacaggaaaggagggagggtgggaggaaatttggacgggtccaaggtcaagcaaagatttttgttgggtaggaaagaactgtttcatgatttcagaaggggaatgatctaagagaaaggcagacactgaaaatgccgtggaatagcagaatccctcagcaagttactacaaaatgatctaatgatatacatttattatttaaatataactttaaaagttaaacaaactgtctaagaatgtttgatggcatttgagttttttaaatgataagatatgcttcttgactgttttaaattgtgatataatacagtatgtctcgtgaagttggtgttaatgcatctgttctgaaaactgtattgtgttcatttttcttgtattttatttatagagactatttataccttcatgtatttaggaatatatagataaatacatgacctatattcaaactgtgaaatgaatcaacagagatgaagcatattgtgcttaaataatcactacactaggagtcaggagataattgttcttattccaaaaactcagctattattgatctgtgctaccttggtcctgtaagatttcactcagctctagatgcctataaactagtcaatcaatcaattgtattgagccccacatcctcaccaaattatgaagatgatgctcccatagcagcatttctcaaagctgacagatctttccttgttagtaattcttctgtgttttcaaccctgactttctgacagagaagacacctaaggcttcaaccagatttgggtatttttctttcttcaagtctttagatatttttttccctttattaagtgaggataagaaaaaaatggaaacaaaataaataccaaatatacaatattaccaggaattatctgagacttccttaggctacacgcacattacttgtaactcattatatattattaatatgttattaattagtgagggaactagttgataaattttaacatgtaagtttatatgttttatgctaacaactctaaacttttagattgctatttacatctctgtgtgtgtgtgtgtgtgtgtgtgtgtgtgtgcatgtgtgtttgtgtgtagggggttcttgtttttttcattttgattgatttgtttcgtttttatatatgtgagtgcaagatagtgttttgtgtggctgttatgatggaatcattttacaagtcctagaaatgattcatttaaaaggaatcattttacaagttctagaaatgatgtttgctccattggcaatgttatctccaggtaaaaatgaccatcatggttaaatcctagtctatacatccgaaacaaatatattgtgttttttttaaagaaatatcagggcatggaacagatcatatctgataaaatataactcagtgtttgcttattccttctgggtatagtattttttgtttgttattttattaagaaaaatacataaatatataaaagaaaagtgctgaaatggaattgtgctttcaaaatattttgaagacacattatatttagtagatagtttttattaacgtaagtcaactatgtatttccatctagatttgaagtgcaaataatgaacttcaacactggatactcagggaattttctgcattctttttttcagttttcttactaaatagtataaaaggataaatattcatagagatgtacttgagatatatgtttgactaggttatacattttgtcactgttttacatatttttttcctatctaaagcaagatttaggccaggcgcagtggctatgcctgtaatccaagtactttgggaggccgaggcgggtggatcacttgaggtcaggagttcgagaccagcctggccaacatggtgaaactccgtttctactaagcatacaaaaaaaaaaaaaaaatagctgggagtggtggcgggcacctgtaatcccagctacttgggaggctgaggcaggagaatcgtttgaacccaggaggcagaagttgcagtgagatcatgctactgcactccagcctgggctacaagagcgaaattacgtcaaaaaaaaaaaaaagaaagaaagataaagaaagaaagaaagatttaaaaagaagaatgaaattttatttgttaattgtatgtaagaaagcaaatttctctaaagaggaaaaaggcagagcaactattaatacaagtatacgatttgtaagtagttggttccttaggtaaaaaaggcatagaaatacctacaaaaattagtgttattaaataatttcattcatttcacagcagttaccttaagagaaatccccttacatcatatgataaatacatcctggtttaaatcagctgacaggtaaagggatactcaactcaagaaatgtcaaatatttaaaaattccaatgataattcacatatctcattatatcatcttaagatcattgttgtgggagaatttttgtttgtaggaccaccaaccattccctggttaaaaaaaaaaaaaaactacttcacccccaaaagcagccttttaaatttattttagtgttgactcgattgaacaagtatttcttaggggtctactgaagggtctatcccatgcccacccttgctctgcacataatgacgtaacgaaggatgcagggtaagtataatttctgattctaaaggacttatgctttcattggagataaaaacttgcacacaggaaactatttaaaaatctgtaagacacagagatctagattaaatataatcattggtaaaaccactggtcaggaatggaggacatcgatggaggctgcagtcatcaagagaagctttctgaatgagtatcttgacgagcagctggatggtttgtgactttgcagcatttcctacagggagtgatggagatccaagcagatttggttacagatgtaataaaaaggaagaaaatatgtgggataataagaaggaaaaacatctttttatttgttagaatacaaactaggagaagttggtattctgaagagaggaaggagtcatcaagaacaagcacaaacaaatgaaaagtattcacaattctggtaacttccaattaattataaataactgtgtatatcaaaacccgtgttattaagtaggaggatgatctggtatgacttctgtcaacccagtgattcaggattgctttgttgatctacttgtccagagagatagatgttacaccacttcttgctatgccacatggccttcgttggaagctatgcaagaggatgactcttatagatgacagaaacatttatgattattcagttggtttcactccttaactaaacagaacctccagacaaggctttaagattctatttcccacttattgccatgatataatcagaaatttataaaattttacccaaagacctaaagagatctgattcactataaaggaaataatttaacatatttaactatagattataacatagtggactattacactgatcaaactaagttataaaattaaaaattagaaactttagctatcagaaaatgtatagttaagtgttggtaattgcaggataccaacagcttttttttaaaaagatcacatgatttagcattattaaaatttattttcatatttttaatactttaatacttgtatgacttaattgagatgaagggcaaagaagaaagatccctttcttgtaataccttgtatttcacattattgtctgtaggtctccataattctggggctctcttccatgtcttcccttttgccccctatttttcccctttcttgctttttcttggcttttaaagctcaaacgatgaatgtttaaagaggctattatccttgggttgaaagactcattcagttctctcttatcttttacatcaaggactgattcaaaacaacataattaaaataaaatacagcataattaaaacaaagcattctgaatagtaattttttttaaagctaataggatatttgtaattatgtcttttcatttttcagtaaagccttctttaattgatatgtggtgctatgtgcagatgaatttttagatgcaaatgtgtataagaagtattgctctactggtaggcatagctttaatatgatcttccaattcctccaaagactacagaattggggtacaagtagctgtttgctctgctcaagttgagtccttctgttttctttgtccctggctttcttcttctgtcccaatggctgtatctcactgtttatttattagctgtttagtatgaaaaaaatctactcttttaacattgacaacaaatcagagtaatgagcctgcccctcacgctacattgggtataatctttgccaattaggctcttggctggttttgatgcactttaccatcctgaaagtttgagaaatctgactgctttgttggttgttgttttcctattcttattagcacttgccaaatcttttgtcatgcatctttagaccaatgacagcttctaggtcaaatttcagttttgatcactgcatctttagaagtaaagctaaggactgaaatagccagttccttttcagtggctgcaatggatgctgattagctgcatgctggttgttgaagtcatagcaacaagtcctacttattatcttttgggcatctcaaataaggttctttagtctttgaatatatgactacaaaaagtttcatctcctagtgaaaatgaatatgttctttcataggacaacaatttcatagagttgattaagcattcttgtctaatgttcatttctgaacaagtaagctgaaattatttgcactcctgtctttctttctttgtccagttttcataattaggctttcagtggacttaatcttttaattttaaaatgattaattgccaagttgttgggtgccattgcttaggttactaagctaaacatagccagcaataacaaagagaagtgcattgaagtgggctatagtggcaacaaatatttacaaaaagttcattttcaacaatgactcaggatattttgtagtcaataatgttgtttagagaggagatagctatggttgttttatttttctagataaaggtagatttgggaagataatcttgttttgtattaaattctactactatataatttataaatacaaatggattttttctcttttcacaactaacaaataattctaatttctgcttacataaaacctcttttggtgttatggaattataaagtttagactttttcagtcaggttaatgggtgaaaaaaggttatattattttactttatacatcatttgaaataaaattttatatcattcaattaattaatttctaagcaacctgaaacaaaacattcttccttggcaaattcatgacagtttcatggcaatttttgatttagaaccatctgttctcaacttctagatccactaaattggagaaaggatctattatccctaagtttagttatgttatttgtaggcctaataaaaataatatataatcgtggagttgttgagatgaataaatgagggaaaataagtcaaatagcttaacaaagtcaccaggagaaagtattcaattaatataaagacaaacacacacacacacacacacacacacacaaacacactttagtacaaaagtaagtttgtcttaactaagttttaagtcttaatttctttttaaatctatcataaagagaactttagatttgtaatttaagacaaacttcaatcaaatgagaggttatttttctaaaccaatacacactgtagtcatgtgttttcttaggaataagctgatcatttaaagcttttatggatattgttaggaagaagctagaattaagagccaggtgttggtcaaaagacacttagagatggtcctaaaaatcagagcttgctaagtctatctgtgtaattcattcaccaagtaatttttaaacttgctatttgctagacagaatgcttagtgctacacatttctaaagaaagataaaatatggtacttggtataataataaaaccgtaggaattatatggcataacagatgttgaggtggaactttatatggtgtatatgggcagaagacagtagttgaaattcctcttaaaatgtcagtaaaggattcagagacaggctagagctaatccataaaactttgaaatgatttgcctgacttatgaatcaaggaaaaggccttctagccagaggagtagtatgaataaaatattgaaatgaaaaaagcatgaggtattcaatgaattgtaagcagctcagttgactggagtatagaaatgtgagagatgtgcattgatcaacaagagctcaattagggggtggggctcttgcatgacatgttagatggttggccttttgagcagtaagtgtgtagatgcactgttggctatttgctggggaaataagatacttaaattgttcacttaaaacgatcattctagcagcaatggagatgaaaaatatgatacatgggagattataaacaacaggaaaatataagaaaggttttgtttaagaatagaggtaaatacgtcaagtactgcaaaaatttaaaagtctctttttcttgtttgtagaggtggagtctcactctgttgcccaggctggagtggcagtggcacaatactagctcactgtagcctggtgggcagaatgcagactcttctgggctcaagcaatccttccgcctcagcctcctgagtagctgggactatacccacagccactgcacccaacttatttaaaatttttttttatagtgatagggtctcactatgttgcccaggctggtctcaaacttttggcctcaagcaattctctcatcttgacctcccacagtgctggaattacaagcatgaggcatcacacctggcctaaaagtgtcctaaaaataattctttccaaataacacttattggaatggagggatggttaaagagctgaaatttcattttcaatgtttgaaggaaaaaaaccatatgatcatctcagtaaacataaaaaatgcatttaataaaatgtaggccaggtgcagtggctcatgcctttgggaccctgcactttgggaggctgaggggggcagatcgcaaggtcaagagttcgagaccagcctggtcaacatggtgaaaccctatctctactaagaatacaaaaattagctgggtatggtggcacgtgcctgtaatcccagctacttgggaggctgaggcaggagaatcacttaaaaccgggagatggatgttgcagtgagccgagattgcaccactgcactccagccttagtgacagagcaagactccatctcagaaaaaaaaattataaataaatgaaagaaaacatatttaataaaatttaacattaacttatgataaaaattataagtaaattaggaatagaatagaatggttataaactgatctgggaaatcctgcaaaaactgtaagtaacattatatttaatggtgaaacactagaaacattcccaataacgtcaagtacaggaaaaggacactcactcttgccattgctattcagcgctgactttgttttcctaatcagagcaatcagaaaagaaaacatataagtggaaaggttggaaagatggaggcaaatttggcattaatcaagacaatgcacttgtctatataataaagacattctacaagaattaaaaataataagagatcagcaggaatgcttggcataggtcaacatgtattaccaagagcatttcagtatctcaacaataccaaaacaagggtaattaaaatctaatttacaatagcaaaaagttttatactaatcccagcagtaaatttaccaaaaatatatgagattttaatggcagaaagcaaatgtgaacacatgataagatagatctggttagcagatatgcaatctcattatcacatctctttcaaatatgtgtgtgtacatatatagatatagatatacatatattttcaaatgcaatttcaagaacattttcaaaaaagttttcatggaatctacaaactgattctaaaattctgtaaggaaaagagatgttctataaattgacataattctgaaaaagaaaaagaaggtgggagaattaagccttctaaatatctagacttattcttaaactacagtaattacaactgtggtttagcactaaataaatacatagatgactataacccaatataggtcaaaaatagttcagctttctgtgtccttgatatataataggggaggaattactaatcaatgtaggcctactcaaaaaatggtgatgggacaacaggtttatgcagacaatgaataaattattttactgcctcacacatatccctatcttaccctacacatgaaaataaattctagatgcatctgataagagttacctaataaagatctaattgtaaaaaacaataaaaatataggaaagtatctttattacactagggcagggaaggattttaaaaatatagaggaaaagtagtaataaaaaatactgacaaattttaccatatcaaaatgtaaagcacttctatgaagcaataaaatattgaaaaacaggttggatttttttaagtgttaagaatatataaataacttatacatcactaagaaaaaagacaaatgatacaatagaaaatgagcaaataaaagaacaggagagggctgggcgcggtggctcatgcctgttatcccagcactttgggaggccaaggtgggtagatcacaaggtccggagatcaagaccatcctggctgacacggtgaaacctcgtctctactaaaaatacaaaaaaattagccgggcgtggtggaacgcacctgtagtcccagctactcggaaggctgaggcgggagaatctcttgaacctgggaggcagaggttgcagtgagctgagatcatgccactgccttctagcttgggtgacagagcaagacttcgtctcaataaatacataaataaataaataaaaataaacaataatagaacaatataatttcatggaataagtaatcatggatgtccaataaatatatcaagaaatgctctgatctctggtaactagagaaaatcaggtgtgtgtgagtgtgtgtgtgtgtgtgacagagagagagacagagagagagagagagagacagagagagcacaataggtaactggagtcctcctatatgcattaaataaactgagttaatagttgtaaagcttgcaacaaagaaaactccagatgcttccctggggagtctgacccgccatttaaggaaaatataatagcagcagttctatcacaaaacctgccagaaagaaagaataacgaaaatcattcccaacccattttatgaagccagcattccctgatgccaaaagcagacaaaaataaaataacactctagactaatatatctcaggagcatagatgcaaacttcctcaaggaaattttaagcaaattgaaaccaatatgcaacatgtataggccaagtgggctttattctaagaaagcaaggaaatggtttcaaatggtttaacatttgaaatttaattagtgtaattcaccataagaacagattaaaaaagaaaaaccttataatcaccacaatagacatagaaaaagcattagacaaagttttagcatccattcacgataaatttctttaactaggaatagaagtaaacttccttaacctgttaaaggacattttaaaaatcacagagggagatggaattttgtctgctgagacaggaccttcaaaatagaaagctctgcatggtatataaagagctccaaagaagcatgagaaatacagtgcaactgcgttatcaccatgaaattaaggcattgtttaaaatatttgttaagccactttccattctatgtatctgtctgatacgttatgcaataatcacagccacttgaagagttggaggtcctttaaaatctgattatagattatctgtcctcatagctttcctccttcgttttggtcctttaaattctcccctccccatctttgaggcaccttgtgctatattgatttattatttaacttgataccagggatgcagcctgcaataaaagtcacttgacaaaataaaattgcgttatgttctatgactcccacaaaaaatgaaaaccatttacaaatagcaccaaaatatataaaataggtataaaccgaacacaatatgtacatgccgtttatgcagaaaaatacaaaatagccatgaaagaaaacaaagacctaaatagaaagatacaccacattaattgattggaggactcaatattaaattgtcaattctctctaaacctatctatagattcagtgcaacctcaataaaaataccaccaagaagttttataggttgattctcaaattcatatggaaaggcaaaggaagtagaatagccaaagcaattttaaaaatgaacagaattggagaagtcatgctaattcattttaagacttattctacagccatcataatcaaaactgtgtggcattggtgagaggatagatatatacattaatggaatagagaacaaactctagagataaacccacatcacaatttcagcttatttttgacaaagatacatagagtattaagtggagaaaagcaaagtattttaaacaaatgatactggaagaattagacaccatgtataaagaaatgaaccttgaactttgacctaacttgtacattataaagacattaactcaaaatggatataaaacataactgtaaaacattaacttacaaagcttttaagagaaagcaaaggaaaaaatctttttgaccttatgttaagcaaatatttcctaggacaaacacaaaaagtctcgttttgaaagaaaaagttgatatccatcaaaatggaagacacttattttgtgtcttattttgtgacacattaaggaaatgaaatgacaaaccgtatactgggggaaatcatttgcgaaacatatacctgataagagactgatatcctaaatatataaagaataataaaaacccactaacaagaaaacagagggcaaacaacttacatagacacttcactaagaaagatatacaggtggcaaatagtcataaaaatacataaaatattattagtcagtagagaaatgcaaatcaaactgacaatgagataacacaatacacctatgggaatagttttttttaaaaaaggaaaacagaacaaaaatccaagcaaagaaaaccaaaaaaacctgacaataccaagtcctgacagtggacagctggaattctcaaacatcgttgtgggactgctaaatggtacaaccactttgaaaaatggcttggctgttttttataaaatcaaaaatacacttaaaatgttccagcaagccctcccttatgtatttacccgagataaataaaaatgtatgttgactcaaaaatctgttaagcgcaggtttataatggttttatctgttgtcattaaaaattgggaataatctgtgaccttcagctgctgaatgggcgaactctggtgcagccatagatggaattctactcagcagtaaagaatgaagaaactctcaataacataggacatggatgaatcttaaatgcatgctcagtgaaagaagccagactctaaaggcaatcaatcaatttatgtgacactctcaaaaggcaatcaagataaaaaacaaagcagtgcttaagagtggttggaagtgaggcaagtggttgactacagatggacaagacaatttatgaaaaattgttctatctctcaattacaatgatgtttatgtgactgcatacattttccaagatttttagaattttattctaaaaaggatgagttttctgtgcaacaagttatatccctttaaaagccagatgaaatctgatataactaaactttgcccttggttgattttgagtggtaggtcatttttgttaattatattatttttatgcttttttccaccaaataaaaataaaataaaaactatttccccagtttttaaaagattaacaataattacctctagataacactttccctattcctgcttcaaaccgtaaaatcctgtatttgtaatctttcttttattcccttcatttccttcagtttcatacaatgtacaaaatctttaagtgttagacatagtcgaagtgataatttctgtaagctacttttgattaaaatcattcaatttagccaacgattatgcatgagataatatgtttcacttattttatattaaaaattgaatgcatcttaaatggcaaaatatgctaacaaacaaacatcaaaccctacgcctgctgagctggtgtactgattgagaggaagccttaggattcctaactcttgagaagtgacctgtacataaatcttttcagtcgtcacatcactattattattgccaagataaatatttcatacattttttcaaatttgagaaacatactttcaaaaacctgtcttgattctacccagcagaatttggaaacaaatattattataatccatcaaactaattcaatcctcattttaagaaccccagtttatttaggaagaacattcacaaatttactagaatattccagttagtaggcattgatcttacacatatgaaaactaataataaggcccgtgtcagaaagcaagctaaatagtcatacttctagggttcaaatcctgttgtcagtacattcaaaacaactttaaaaatttaaatgatcttacggtgaggcctcaaggtttttgttttgttttgtttttttgagacagggtctcactctgttgcccagggtggagtgcagtggcacgatctgggctcactgcaatctccatccctgtggctcaagcgatcctcccacttcagcctctggagaagctgggactgcagatgcatgccaccacgcccagctatttctttctgtagtttttgtagagtcttgctatgttgcccaggctggtctccaactagtgggctcaagtaatccacctgcctgagccccccaaactgctgcttttttaacttttgtaaaatgataatattacttaattcaaggtttgttgtatggattgaagatatgtaaactatctcacacagtacccagaccttagcagatcttcaaaattagctgttataaatttcattactggatgaaataatactcttaattatagtcagggcaaaatagtaaaccagatcagtatacttgactgcagaggagtagatgtaaaactcacaaaacaagaagcaaatagctctcttagcattactactgttgctagttattactattattatttacttttaattaacttagtggtaaatagaataaagctatcaattacaaatttgtggttggaaaataagtaattgatattttcagcatcatagcctaagtgaaaattcattttcttctccctgtcttttcctgtgaacttttgccatggttccaggtctataagcctgatctcagaaactcaggagctctccatataaagtttttttatatgtattttttttattatactttaagtcctagggtacatgtgcacaacatgcaggtttgttgcacggatgaagctggaaaccatcattctcagcaaactatcgcaaggacaaaaaaccaaacaccacatgttctcactcataggtgggaattgaacaatgggaacacttggcatatgcatataaaattttagtatgattgatatttacttttgactctgctttagtaataggctgctgaacttaagaacggaataattgactcagttgatgtgacagtttttgctcatcctataccacctggaaaagttgtgtttaaataacctttcaggcagtatggtgattaaatattcagtaatataaattgatgcttgcttgaaaaacaagtcgttagtttatggaattgaaatagaatccaagtagtcttcagtgttgttaaacttacacctcatgaaactgtagtcagtctttacattgttgtggcagttgtttcttggtaaaaacgagcttctattctgaccagatatttattttaattaagggaaagctagcatttgcctgaagttgaggaataaatggagcaattgtgaaatatttattggaattttaaagcaaggtttccagaattcaatttggattttttttttttttgctttaaatggacagttttaggctttacatgggctttgataaaatagatacaacactgcaaagataccacctttactatgattgagttaatgcagctccacgattagcagcggttcttaactctcactaatgcatcagactcacttagagagcttttaaaaactagggctatttggcttacctattgagatagagtttcagttgattcagattaaaactcagatattggtattttttgaaaaacctatagtacttgaatccaatatgcagctaagcctgaatatctggttgaaagtacttgaattagacactatggttgtttattgccatattatttgttttttcagcattgactcattgtaaaaaataataatagtacatctcagtggctcacacaagtgatttatttctctcttaagtcacagtctggcctgagtgggaagaaggtatgtggaggcaagaggggaagggactgatctttttttgggtactctaaaagaaaatactaaatgatagcttatatggtttggctctgtgtccccacccaaatctcatctcaaattttgtaagccccacctgtcgaggaagggaggtgtttgatcaggcaattggttttccccatgctgttctcatgatagttagtgagttctcacgagatctgatagttttataagtgtttggaagtctcccttctattacttctctctcctgcctcctcgtgaagaaggtgcctgcttccctttcaccttctgccatgattgtaagtttcctgaagcttccccagccatgtggaactgtgagtcaattaaacctatttcttttataaattacccagtcttgggtagtatctttatagcagggtgaaaacaggctaatacaatagcacatcaaaaatggtattatttcttaaaactttgtttagcatcttgaaaaaagtaacaatacatatttacttttaaatgtttggaaaatttggagaaacctttgaacctgacagcattgaagtaggaccacatagtatttggagggttaagtggtgcgcatgcgaagggagactactgagcagaagtgtttaggaattcaagaaggttaaaaagagttcagttgggagtcacactttctttctgccatttgattataaactatcacctcttaagaagaaccaggaatctctacttgaatttaagcataatgttactgcatcacgtagacattgaatatagttttatacacttttcctgataatgtgaagttaatagcctcactgtaaggctaatgatatgggaaggaagaagagaattattaagattgtctttaactttttatataaatattattttgtatgaatacaagtttgtaatcacaaggcatttttggtaagaatttgatttaagatatgtatcaaataatgtattactatttttagatattaggaagaatatagtatgtttccattcactaggaatatctaggcttttctaacaggtatgaagagcttatgtaaattaaaacccatatttcaagatattattagagcaagaagagttttattttccctaaaagacaaaacattgaaagaaaagttgttcattttttgtagtatttgtcagcatgctgacaagaaagtactaaataaaatacagctaaactttgggcgtacatgactgttttatccattgtaggaatactaaaggtgtgaacactgattttcaatttgtgataggaatttccattattaggacataaaaaatcagtctggctactttacagtcatgtcatattccaaagtctaactttgatgaattcttgtctcagatatgttgtcttttggagaccagttgttcacactcttctatttctttgatttgcctattaattatttatttaagaatacaatgttttgaccttatttgaatgagtttattaacatattagcttgtagaacatttatataattttaaagatctggatagtttccaatagcttaattatgcaaattcacctatacttcttatatccaacaccattatggaatgcagggttgtctatttgttttatttttcttgatttattcaattctgtccttttatgcttaaatctaggcattctacttacttgttatgcaatttgtgtgttttacttgagttctctgctgtcatttctctgtgtgggtggttctacctcacttgtaccgttacaatgatggtcagaagcagagagctccacgggactgccttagtccctgacacaaggcagggcctggccaatggagctttctattagtggaccgttcatctgtgtacccatttccacagagtcaagccttggtggcactttgccctctttgttgtagaccttcacttaatgagtatgcatggtccctaccgttggttctgaaccacattgttacactataatattatgtttatttagctattgcctgtggtaaggaaaaaggacagttttaataataaaaaaggggtttgaaagacaacatattggctgggcgtggtggctcacgcctgtaatcccagcactttgggaggccgaggcgggaggatcacagggtcaggagatcgagaccatcgtggctaacatggtgaaatcccgtctctactaaaaatacaaaaaaaaaaattagccaggcgtggtggcaggcgcctgcagcccagctacttgggaggctgagacaggagaatggcgtgaacttgggaggcggagcttgcagtgagccgagtgcagcttgcagctgcactccagcctgggcgacacaggaagactccgtctcaagaaaaaaaaaaaaaaaaagacgacatatttaagccacaaatgtgttaaaaattgtgaagtaataaaacctggtaaaaacatcagtgtgaagcatggtaggtgacttattaaaactggataacacaaggccaaattagaagacagtctaaatcactgaattttcaaacacaaatagcatagtttttttttattcctagcataccaaaagccttgaaagccactattactatggttttggaaagaaaaatcttatctttttaacggtataagcagatgaaaatcatttaaaatgacctcagcaccttttacagagaaattaatttagtgttatttttgggtgctttttcttgatagataactaataaactaattttcacactgaagattctatgattacatttacagtactttatctttgattaataaatcttttctgttgaacaaagatacatttaaacctatgatagattaagttatctaatactaaatcagtgcaataagaactaataatgttttagaataaggtgtaagtgtttaaatatttctaaaaattagttaggaactggtgagaaatgcaattctagaggcattagtgcaatgctgagaagtctggattttttggttgttttgtgcccattcatttactcgctaaataaattttgattgaatgaccatcatatacctactatgttccagataaactgttagatgctgaaaatataatcatgatcaaggtaaacatggttagttatatcacagatgtttacaggctaatggggaagaaaggcaagtagacaactgcaactcaggtattggtattccacatgacccaataaatcttgttactcacccaagtttggattgtagacaaacactctggcagatggagctaaaaatgttagctgcttttactgatgaggagttttgaagaaaagaactttagttagtctttccaagggggcttattaatgcttcagcttggagttggacagatttacctgtatacaggcaaagtgcaagagaggctgctgctcagagcctgtcccctaatcatgtatggcacagatgagcagagaatgcaggcaggcactagcttgttgtattagagaggcatgtgtgaaggctgaaagtggagaggtaggagattatggacttgagggaattgaaagtagttcagattggctgatgtataggccaggtgcggtggctcatgcctgtaatcccagcagtttgggaggctgaggcaggcagatcacttgagcccaggagtttgagaccagcctgggcaatatagggagacccctgtctctacaaaaaataccaaaattagctgggcatggtggcatgtgcctgtagtcccagctactcaggaggctgaggctggaggatagcttgaccttggaatgttgaggctgccgtgagccgagactgtgctactgcactccagcctgaggcacagggtgagatcctgtctcaaaaataaaataaaataaaggaaaggtaccaggagaggtgtctggaagacataaataggattcttatgtacatggccttgtggtcatgttgaatagttttgattttatcctagcagcttggagctgttgattttaaacagacagttgacatagtcacattgccctttaagtgtcatttagggctgggcatggtggctcacgcctgtaatcccagctactcaggaggctgaggctggagaatcgcttgaacccgggaggtggaggctgcagtgaactgacatggggcaactgtcctctagcctgggtgacagagttagaccctgtctcaaaacaaacaatcgatcaaacaaacaaacaaacaaggcatttaggaagcttttttcagggtggatctgaaagggacaaaacagaacaaaggatctaccatacaggctgtttatttttatttttatttatttatttatttatttagagacaaagtctcactctgtctcccaggctggagtgcagtagcatgatctcagctcattgcaacctccacttcacaggttcaagcaattctgccttagcttcccaagtagctgggattacaggtgtgcgccaccacgcccagctgttttctgtatttttagtagagatggggtttcactgtgttgaccaggctggtctcaaactgctgacctcaggtgatctacctgcctcggcctcccaaaatgctgggattataggcatgagccactgtgccaggccaggctgttttaataatacaaattattattaaaccaaaaatgatgagttaaaaactgtgaagcaataaaagctggtgaaaaaaaagtcagcataaagcatcatatgataatttattaaaagcggataagacaagcggcggtggcgcagatgtgtaccagagtaatgagagtctgggtgaataggttggaaaacatttgctattttatctttctagacccttcttagccatttcactgctcattagcacctccactgagaggctagccaggggagctgagtcagatctttctaatattctttcagaacagtgtttttgaagaatgcttagtaatttttaaaattgcaattgatagtcatgatgtggtttgggattaactgaaaattgcatttattcatcctgtcccaagatctcattagcatgtatgactgagttggaagtgaagttaattatgtagttgacccttttaagtacctcactttgcatgtgataatttgtaagctttctgcaaaattttaatttgaccacctcaaaggagtcacagctttcataaggtggaccttactgaaaacaacaatatgttaaacagcaaaaccgtgttctaaagctttgtgaagttcattttgggattagataaaaagctaaataatttcttgggtcatgcttgtttttaagaataaacttttcctcattgtgtaaactctgttgacgtggactgcttttggtttgaagacctagagtagacactgaatgccccaaggctcaatattcacgatattatctaatctttgactttagaagatgttgcatctataaagttaaatcctctggaccttttcatgtctatttctttaaacttctggtttatgatttgccataaatcatctcttttcaggtgggtgttcactgttatggacacactttgttttcattgacatagcattgtgagattatcaatggacatagatgatcgtcatgtgatcatccattcatttccaccaacacttagtgagcactcagtttatgctcagcactattgactgccccatggatctgagtttaatagtatagaaagataatagatataactgctcatgagaaatatgagtagagatatacattgtcacagcatagaaaagacagtaactaattttcccttcataatcaagaaaggaaactttgcataacaatggaaaggagtgtttcgaaccactaaaaagcatgcatcaagcagaggtattcacatatgcaaagaaacaagcccaaaacaaaggtaatgtgatattttatattttatttttctctgtgttaacaaagaatgttctctaaattttaaataataggctatacatatgaagatcctagcaccgtaaattaccatttcagattttattcttaaacatcttattttatagtgtggagcctgaggccaagacaagtgaattggcttgtccaaggtagtatggttgatcaaaggcagagcaagtctgcaagtgaaaacgcttgcatttaagatcagttttaaaataccgtgttcaggattgttttgttgtttttatctataagtctctttagaaataattactggcatgaatttaacaatcatccgtgattttgcattttaatgtaaacaaaatcttttgagcaaaataaataatttggatttttatatagatacactggaatattgtattcttcttaaatgtatatacatcacaaatttttttaaaaaaatcttctattgcttttagtagctgactttgacacaaattttcttttttaaataaattttagagctacacgggggttctttgagtgaactgatgaataataaagtatatgcaaagaatcataatgtgaagggaagggaagaatgaatagtagcaccatggagaatttaggtcaaagacactgcacgtgactctcttctgactggaaatacttttcaagtagacaaccgcggagaacaatgtactcagctgcatgccccagcagtaagacagcgtgtgtcaggccaaggaaataactgtttccaccctcccaaaagcaagagatcccatcactgactttcacaaggtgtgatttttatctctactggtttctctttctaaaaccaaacagctagaaattatgcagactgtagccattccttattgatgatttcaacatctctatcgtactttcatttttctggaaaaaaaatatgaaacactttatttcaaaacctataatacagaaagacagctccagcagaaacttcaaaaccactgtttcttctaccatctctctattcactgcacacctccttctttcctttggtttggttttcttgatagctcagttggctcccctgatgccgcccgcttccaaatagggtaatatagtagagttggagagagatataaaggagagggagggggctaatttagggagaggagttgctggatgtcattctgttgaatgtgtttggttctaatttttacgtgaaaaagatgaatgaggtttttaaagaaaattacgtgcacgcaatatttttggtatattaagcacctactttacttcctcgtttgattgcagctgtgaaaataaatatgatcagaaaatatgctttatgttggttttgatgcatagtaacctaaaggcaggtaccgggtccttttcagaatttttttttttttttttcacggaagataaagagaacactaatgacaggtttcccaggagcgcagcagcagcagagttaaccttgcagcctacagttttaatccaaaccactaagatattagggctctagaaaatctaaatatgttctgtattttaaaatagagttaataaaaaatgtttgaaggtggttgatgctgcagacaaacagactttgtcagggaattgcaccttttctggggtctgtatcctttactttcctaactgaggctgtattgtatttgcaactttcactgaattccccaggagcgctctgcgctgctcaagcacaggctctggcgtccatctctgtaccgcaccctgtgttcttcagttgggaaaaaaaagggtctgtcggtatcgagtgatgcctacacttggtaagagcagtggatctaacaatcggaagatttcttcttctgacagcttagtaatttagtagaagcggtgacaaagaaaaataaaatcttgcttttcttttagttgcaattccttccttttaatgtgaccttttatttcaacataagaagtttgttgtggcttcgaagatacagcttgcttcaattcccttctcccttttccttttttcactcgtgactgtgttaagcttcacaaccctgcatatgaccctttaaatctaatttgaatgaggaaagaaataagcttagaaagaatttgtcttccaaagacagcaagaactctgtccaactctttctgtgtattccttgtagccctctattttataaacgtttgtcagtaaatacatatgttataacacacacacacgaacaaaccaaacgtattacaaagtctattgttattgtttaccagtaacttttttttcatttcccctgctttttgaattttgttcttttccatggaagttcactttactgtgtctctgaaaactgtagggcatttggctgctgtgaggggttcatgtgtttgctgcaatgagagtctgaccttcaaccctcagtttccttctctgttacaaagcacaagtctggtgtgtttctgtttaaaagccaaaaaatcagatttccggtgaaaacaaacttgtttattgagaggtggcaaagtgcaagggcaaaatagttttatttccagataatttgccaaatatttttcagtaggagaagttttctttgatgaaaaatgtttttagaaaggagaaaggaaggacacagtggaatatttcggcgtcattgtgttttaaggaacaataatatctgaaagtaattgctgaattggtcctgaaagtaaaagtagttaaattgctttatttttgtgcttaataattactcattttcaaaagatgattgtatgccttttggtgggttttaaaaaattaatagacattatttttagagccattttagattaatagaaaattgagttgaaagtacatagagttctatttaccctacatccctccacacacactttccggtattactaatattttgccctgttgcgatacatttgttgtaactgatcagtcaatgttgatatattgttgttgttattattcttattatttgagcagagttttgctttgttgccctggctggagtgcagtggcatgatctctgctcactacaacctttgcctcccgggttcaagagattctcctgcctcagcctcccaagtagctgggattacaagtgcccaccaccacgcccagataattttttctttttttcagtagagaggggctttcaccatgttggccaggctggcttcgaactcctgacctcaaatgatcttctcgcttcagcttcccaaagtgctgggattacaggcatgagccaccttgcctgacctgatatattactattaatgtccatagtttacatttggggtcaatcaatcgtgttgcacattctttgagttttgacaaatgtatgatgatacctatctactattagagtattgtacagaatagtctcactgccctaagaatcccctgtgctctgccttctctccctccttgtactagacctctgccaccactgatcactttattgtctctatagacattttgtcttttccaaaatgtcatatagttgcagtcatatagtacatagccttttcaattagcttcttttacctaataatatgtatttaagattccttatcttttcatggcttgatagctcattactttttattgttgtaaaacattacattgcatggaagtgctacaatttatctattcgcctagtgaaggatatattggttgtttccaagttatttgcaattatgaatgaaactgccataaatatccataaattttgtgtagtctaaagtttttaattcatgtaggtaaatacctagaatcatatgccaaatgtatttttagttttataaaatactgccaaactgttttctaaaatggctgtaccattttgcatctctaccagcccatcaatgaatgagaactcctatttctctacatccttgccagcatctgatattgtcagtgttttggatttttgccattctcacaagtgtgtaaacgtatcttattcttttatccttcagttgtttaaatgacatatgatgtggagtattttttcatatgataatctataatctctatgtcatctttggtgagatgttaggtcagatttattgtccgttttttaattgggttatctgttctattactgtagatatttaagaaatcttgatatattttggatgccagtcattaatcaaatatgtgttttgcaaagatttttctcccagctggtggcctgtcttttaattctctttacagcatcttttgccaagcagcaatgattaattttaatgaagtccatcttatcaatattttctttcatgagtcatatgtttggtaatctgtctaaaaattcatcactaaacctaaaatcacttacatttttctcctatgtcatcccctaagatatttacagttttgtggtttacatttaggtctatgatgtcctttgtgtttatttctgtgaaagctataataactccttctgtattcgttctttttttgcctatggatgtctacttgttccagcatctttggtttaaaaggctgttttttttttcattgagttgcttttgctcctttgccaaagatcaattgactgtgtttgtgtagttctattactacgctctcgattccgttccattgatttatttgtctattcttttgccagtattacgctgttttgattgctataactttgtggtaagtcttaaagtcaggtgatatcagtcctccaactttgttcttctccttcaacatcgtgctgttgatgttgtattttttctgtttctttccatataaaatttagaatcaatttattgataacttgaaaataattggctgagatttagattgggattacattgcaactatagatctaattgggaagaactgacatcttgacaatattgactctttctatccatgtacatggggtacctccatttatgtagatcttgtctgacttcattaatcagaatgttgtagtttttcatatagttcttgtgtatattttgttagatttatacctaggtatttcatttctctaatggtaatgtaaatgacattttgttttttatttcaaattccaaatgctcattgctggcatataagaaagtgattgactattatatattaacctggtatcctgcagactgaaaataatattttattaatttagtaatttgttgattctttgagatttcccatgtagacaattatgccatctgcaaatgaagttttacttcttccttcctaatattaataccttttatttccttttcttgtcttattgctttagctggaatttccattacaatattgaaaacgagtgatgagcaaggacatcctcctcaccatagcaggaaagcttctagttaattgtcattaagtgtgatattaagtgtagatttttcttagctattctttaccaagttgagaaagttcacctcgatccctagtttgctgaaagtttttatcattaatgggttgtcaaatgtttattctgcatctgttgtcataatcgtgatttttattctttggctttgtgatgtgatggattacattaattgatttttgaatatttaactagattttcatacactaataaatcacttttggtcatgatatataattctttttatacattgttggatttgatttgctaatattttattgaggatttttgtatctaggtttgatatttgttgtagttttctcttgtgttgtctttgtatggttctggtattaaggtaatactggacttgtaaaataaattaggaaatattccctccactcctattttctgtaagagattttaaagaattggtttctttcttaaatatttggtagaattcaatagtagacccatcttcatttgctgctttctgttttggaaggttatttattattgatttaatttcttttatagatataagatatcataatcagttcaggctactacacaaattaccacagactgaatgacttaaacaacaagcattcatttcttggtgttttggaggttaaatatcctaaatcaggatgccagcatggtttggttcttggtgagtgtcctcttcttcatttagagagggtggtcttcttgcttgtcctcacattgcagaaagagagctgcctagctctctgacctcttgttataagggcactaattccattcatgagaactccaccttcataatctaactgttcccaaaggccccacctccacacctccaaagaccatcatactgggattaggctctgaatatatatatataatattttgaaatatatatatattatattattattgttattatttgagacagaatcttgctctgtggccccaggctgaaatgcagaagctccatctcagctcactgcaaccttcacctcatgggctcaagagattctctcacctcagcctcctgagtagctctgactacaggcacatgccaccatgcctggctaatttttgtatttttagtagagacagaacttcaccatattttccaggcttgaactcctgagtttaagcaatcctcccacctctgcctccaaaagtgctgggattacaggcataagccactgcaacaagcctgaaaatataaattttaagggcacaaaaatgttcatttcattgcaaaggtctacttagactattagtttttctatgtgtaagttttggtggattgtatcttaaggaattgttccatttcattttggttatcaaatttgtgggcatagagttgtttgtaatattcccttgttagcttttaaatgtctatggattcaacagaaatagaccctcttggccaggcgtggtggctcacgcctgtaatcccagcactttgggaggctgaggtgggcagatcacaaggtcaggagttcgagaccagcctggccaacatggtgaaaccccgtctctactaacaatacaaaaattagctgggagtggtaccacatgcctgtaatcccagctactagggaggctgaggaaggagaatctcttgaacctgggaggcagaggttgcagtgagccaagattgcaccactgtgctccagcctgggagacagggtgaaactctgtcttggaaaaaaaaaaaaaaagagagaaatagtccctctttcatttctgatattctgatttgtttcttttctcttttttccttagttaacctaactagaggtgtatccgttttattgatcttttgaaagaaccattctatggtttcattgatttttctcctttgatttcctgttttcaatgtcttgtattctactttaattaatattatttttttctgctgcttactttagagttagtttgctcttttttttctagttttcttgggtagaagcttaaatgattgaattttctatctttctttttttctaatatatgcattcaattatgtaaatttttgtctaagtaccaatggtctgtctttacgatttatagctttctgtccttgatttctagtttctatccattgtggtctgagagcatactttgtttgctttctattcttttaaatttattaagatgtgttttaggacacgaaatgtggtctatcttggtgaatgttctgcgtgagattgagaagaatgggtagtctgctgttgttagatgaagtagtccataaacgtcaattagattcaattgattgtgctgttttcttcactgcttttctgcctgctctataactttcaattgcagattgagcagtgtttaagtctgcaactgtaatagtggattcatctgtttatccttgcagttctttgagtttttgcctcaggtatattgctaatctattgttaagtacatgcttattaaggattgttttgttttcttgagaattgactcctttatcattatgtagtgcctctctttatccgtgataaccttccttgctctgatgtctgtactgtctgaaactaatatagctactgcaacctgcttttgatttgtgttaacaatgtaatggactgaattgtgtgccccaaattcagaatgtgtctgtatttggagagagggtctttaaggatgtaattaaggtaaaatgaggtcattagggtggccctaatccaatatgactgttgtctttataaaataggaaattaggacacaggcacacacagaggcaagatcatgtaacgatacaaagagaagaaagtggccatcttcaagccaaggagaaagaactcagaacaaaccaaccctgctggcactttgatcttgaacttccagaattgtgggaaaataaatttctgttgtttaagccacccagtcaatgtggtactttgttatgatagcccctgcgaactaatatagtatagtaatggtatttctttcttcattcatttacttttatctatttgtctctatagctgggtgggttttgttgttgttgttgttgttgttgtttgtttgtttttggacaacatagagtttggtgtagttttatgcacttagtctctctctttttttttgagtgtatttataccattggcatttaaagtgattattgatatagttagatcattatctatcatgtttgttactgtgctattgttttctacttgttgcccctgctctttgtttctttctctctctctcttttttttgtcttctactgtttttctgtcttttctggttttaattgagcatttaatgtgatttttttttcttctctcttaccatatcaattatatttttaaaactttttctgagtggttgccattgagtttaaatatatattttcaattaatttcagtttattttcagaagacactctaccacttggcaatactatattaccacagataggacaagtcccttgtaactgattattccaaattcctccctcttatctcttataacattggtgtcagtcatttcattcatccatgagataaaatcatcgaatacattgttgttattattttgaaccagctgctatctgctatgtcaattaaaagtaagaaaaataaaagatatcattttacccttatttattccttttttaaagctcttcatttctctatgtagatccaggtttctgatctatatcattttccttctttctgaagaacctcttttaaagaagcgtctaccagcacaaacatcctcaattttcatttttcctgataaagacttcacttttgaaaaacaattttttctaggtgggtgggtttttccttttaacagtttaaatatttactacattatctattttgcttgcatggttgtagagagaagtctgatatcattatttttacttctctctgggtaggctcacccactctccaccccaacccggcttctttcaagattttctctgtgtttttgaatatggtttgcctagatttcattttttattttgttttgtatttatcctacttggtgttctccgagattcttagattggaggtttggtgtctgttattagttttgggaaattctcagtcattattgcttcaagtatttttttctgttcttttctctccctccttcttgaattctcattataaatatgttacaacttttgtaattgtcccacgtttctttgatactctatttcattcattttcttctttttacatttcttttttgatgtttccattgacttttttttcaagcttactgagtttttgcttgcctctattcaatctattgatgagcttatcaaaggtagacttcatttctgtcactgtttttgatttctagcactctttagatttttttcttagtttctgtatttctgcttacattacccatctgttcttacatgctatctgctttatccattagagtccttattaatcatagttgttttaaattcataatctgataattctaaaatctcaaccatatctgagtctgattctgatgcttgccctgtctcttaaattttgtttatcttttagtatgcctttcaatttttgttgaaagtaggacattagacactgggtaaaaataaatgaggtaaataggtctttagtgtgggtttttttggtctgtctggctaggaattaggccgtgtttactagtttcctttgctgtaggtgccataggctaaaatatcctcaggtgtccgtgtttctatcacctcagttgtcttcatgtttccctagaaaccaaagtagtaatgagtacaggaggctgcagagcagagagtacagggatgtcctttcttatagtcagtcactgctgggaagtgataggcagctgtgacttcacttgcgcattggagaagcaaaaaaggttgccttattgtcctaggttggtggcaggcttgcttttgctcccacttgggagtgttcttggtgagggtggagtggtctctcagcaacagggagctagatgaaggagtcttaagaagctgatgttcaggagtggccacaggacccagtaaactcacttttacttctggtgtctgtggtgttgaaaaggcatttgagttttcaatgacatataggaggtcaatgttctcttgttccaccatcatgaactgactccaatactccaggggcaaagaaagcaggtgctcgatcaccttgggttgatgcttgatgtcctgtaacattgtcactgggtccggatggtgcacagcatgggctactattgtagggccaaagactttaaccagattggcaacatctggttccctagaaatttcttaagtaaggcctgagacgtgaacattttcagttgtgctcccctgttaatatacaagagccctattgctgtggtggtaaggttgggtgaggggcagcactgtcctgtcctgtcctgtaattaggactcagttttttactgagcctgtgcccttgggctgtaactttgcaggtaccttccctgcttaggtgaaacaggaaggctagagtgggctgaaattgagcctttcccttcttcgaggttgggtaggcactggcagaatattttcccttgagggtaggtcttgctgagaacagaaagctctggtgtttttcgaaagagctgctctctcactctccacccactcacacattggaagctataggcgatttttctctgatcttctctgtgagaacctggtagggctcctgaaggtagaactccgaaaagtgtggggacctcctaggaaggccccactgggagattttaattctcaaacttgtccaaactgagtctccagcaattcataaattacagctttagatttcaatcccagtactagttccagcagagatttctgctccagggaattggatttctgtgtctgcttatctgtctctccagtttttggggggtgtccatttgtctcaagacctcaattctctcatggacctaagaagagctgttgatttttaatttattcagctttctatttgtttttagaatgcagtagtgacttctgaactcctatatgctggccaaaaaaagaaaatcagttttattttgatttttgttgaatgaacattcttctttaaaagtaatctaaaggtgagttttgtaagcattttgaaaatttgcatatttcgagaggatgataagtttccaataaagggatttgtatgcaactgatgagtgataaccagataataatgtttgcaactgacagtccattagctcaaaatgtgttttgtattgtcagctacatttgaagaaagtttcggttaataaagtttcagaaattagcacattggtatgctgaatattattgtgtaacatagacattcttgtgcattaaacagtatgtcctcatcaaattacattatttgcttttgtccctaattcataatggaaaagtagctatgtcttggaagcaactatcattcttccaaaattgaaacaacttcatattttaaaataccatgaattttgtatatcctgatgtggcatgttgtgggattagtcattgcatcacagaattttagaatttgaagagatcttgtgtaattttgttttcatattttacagatcatgtctacagaaggtaagtgtcttatttagggtcagaagctagtatgtgggataattatattatgatagcttaaaatgtgactatcagtattggtcttaaaacagatttagctgaacaatgagaatacatggacacagggaagggaacaacacacacagggttgggggatggcggagacatcaggataaatagctaatggatctggcgcttaatacctacgtgatgggttgacaggtgcggcaaaccaccatgtcacatgtttatctatgtaacaaacctgcacatcctacaagtgtcccagaacttaaaataaaataaaatacaaatgtaaaaaatgggacagatttagcccatcttgttcttatttacttcatcaggggattatcctatagtggaatttagaattatgagcttgaaactctgaaggatctcaaagcaatatctgactcaccacaaaacagctaaattctatgcctagaatcctagtttaatttttttatttgcttatataacaattatttgaaaattgactccaagtatgtcaagtttattttaaaaagtttaattcaaacacattggtcccaattgatgtgacttaacaggagcttatttaagaaaacaagtcaggacatttgtaaattccaaagtagaatatttgactatgatttggtcctattcaatgaggatgctacttagtgacgatgtaaccatggttaatttacttaacctctttgtgcctcaattttcttgcttgtaaagtgggatgtggataatagtttctttctcatagggttattttgaggattaaatacatttaatgtataaattgcttagaacaatgtcagacagtaatttcctaattaatattagttactataattaaagagaacagatactcagactcttaggatttgcattttcagccctcctctatttataaccctttgtaaaaccatcctggacagatgattggccatttctatattacctctaaaatagttcctttcactctactaatttcatatcaatatgtttgcatgtgtgtggagcggggcaggcagtggtggagaggcaggaatgtgtccagtgaatttcaataattgactcttttgtcacacagagtagcaaagcctagtcttaaaatttattgtgcatacatctctagtgagtgaagtagcacaatccccacatcccagttctcctaaagctctgatgctcttctcatcctttctgttatcttcttcttaggtaattttaagtaagcctctgtaattgcagcagtcactgaactgtgcgtatgtggggtgtgtgtgtgtgtgtgtgcatgtgtgtacgtgtgtattcaggatcatttctagatgcatgagaggttattagatggcaagcatgcaaggatcatgtgcagtacctgaatcataatgtgtgaagctggctgttccctgagctctcataatgtgtataacgttaagctgtgcagaatgaagatggggacatgactgtttataaaatgtgaatatagagagttcccatgagttcctggccccatctacccagcgattttgaggatagttacttttataattgttttgagtttcctttgaattcttggcaaaatctctgtttttagtcactatttcttgaattgattttgtagaataatttagttttccttccgtctactattcctacctatattgtaactatagggtttttaagtgtttttgacagattcagtggaaactgttttttaaaaaaacctgggattccaggcaattttattgtatattcagacactcattatgttcttcattcattttttacatttgcaggtaggtgaaattcagccttcatttgaagacaacaaattccggttatgtttggtgggaatggaaatggatctgagtagctttttgtaaaggcagcagtaagagtgtaaactgtgattttgttgagtgaaaccaaaaaggtttcttttagtgtaaactatgcctccttttggaaaccttagtgctgtggcaatgtagataacacagatgtgagtagatcacaccctagtttatttcaagatgtgatctagattcaggcttaatggactgctaatatacactcaaagtgtctagaggcaagcattctccagagacctctagagatctgaggaaacttgtcctcctggtcaatgaatggggggaagaccaatacctttgtttagaatacagttttagccatttttacatgtcaccctatcagttagcaattgaatttagagacagatgttgaaagtggctttatggttctcaagggtagtggctttgaaaatacacttcaaatacaatcataatttgcacatctgtaacctaatgctacagagtggaacagtaaacatgcctctgaatcaacagtggtttcctaaactttgtggagattttattctttcattggctaccatttaaaaagtactttgaaggtgaatgatgccattcaagtattttatatggcccaactaatattttacaggaaagcaaaataggcaatgctctccagcattcacaattacttggaaacaggctgggcatggtggctcacgcctgtaatcccaacattttgggaggttgaggtgggcgggtcacttgaagtaaggagttcgagacgggcctggccaatatggtgaaacaccatctctagtaaaaacacaaaaattagccaggcatggtggtgggtgcctggaatcccagctactcgggaggctgaggcaggagaattgtttgaacccgggaagtggaggttgcagtgagccaggattgcaccattgcactccagcctgggtgttgcagtgagactccgtctcaaaaaaacaaaaaacaaacaacaaaacagaacaaagcaattacttagaaactgtgaaatatcggtgatatgttaggattacaagttacattaatgttacaaaggtaggcacaaacaaaaattatgatgtttttataactttattttttgtctttatttacttattttttatgagaacctactattgatttttttaatatatatactttaaattctgggatacatgtgcagaacgtgcaggtttgttacataggtatacacgtgccatggtggtttgctgcacccatcaaccggtcatctacattacgtatttctcctaatgctatcactcccctacccacccacccactgacagactctgctgtgtgatgttcccctccctgtgtccatgtgttctcattgttcaactcccactaatgagtgagaacatgtggcatttggttttctgttcttgtgttagtttgctgagaatgatggtactgtaatcatcttgttgcatgcctggtacataaatacatggtagggacttacctatgaatttgttcaattaaagtgtaaaataattaatggacttgagagcaggtacccttgtcgtatatggctttcttacctgcctttgctcttagcttagtgtgaagcacagaatttttgttcagtaagtggtgtgggtggagaagaactgatagaaacccactgagataagaggctgtaatagtgggtaaaacacacctgttcatgtgttgtaacttcatttgccagcctgcttttaagcctgagcattcagtctgaacatttccaaggtgcacattccgaaaaactaagggtgtttttggaagctgttctagtaaaaaaatatatttttctgtctttttccctacgcttatatgaacaattgctaaatatattttgataggctgtattttgatagagaatattgagtaatttctgtttactttcccattgaaatattgtgaagtaatctctgactatatgtactctagaatacatagtttattttattctcatgtttatattagagaataatgaatgccttgacattcttacttgtaccaaattgtccttattctccaactctatttaaaaatgtatttttctttcttaaaatacaattgggattaaaattacattaaattgttcagggacatagtattcagttgaaatgaatacttaaaaatttacaaattagaattagaggagggattaatcaactttcttttgtaccttccaattgagctgaatcaattgaacacctctgtgtactttttaactggtagatggcttcttatctcattgaatcttcaactaagtacttcaaaaatttttatttgactgagaaatcatttggaatttgacagaaccaaattaaaacagcttaactattggtttaaaacttactgtaaaactgtacttaccagagataacataaatttgagtataaacaaataaaaagaagagattaaaaatagaaatagtgatatgaattcgagcaaatgaaatataagtagaaaaattaggtgacgctttggtgagattcttacacagaatttgtattgttaagccctacattttatttattgatggctcaaaaattatctataatttctctaacatccatcaaaagagggaaagtctgttgtccataggataaaatgaagacagaacatgtgtctttctggtatatccaagagaaatttggctaatggctcctctagaacaggaatttttaaattttgatgaccaatatcctcaagaggttcttctaatgtatattgtagagcattcggttttgtacgacgcacgtgcactatggcgcccatccatggaattctgtgggacctatttggggttgccctagcagcatgttggtattttacaactgggtctctggtgagggttcagcccttacccgagtatttgtctattttcaaggtgtaactatttccacaaaagctaattttaacgtcactgaaggcagagctggaaagagatacacacaatgggctctccatagaccatgagagccagctccagcatactaccatgtccccagtcacagctctccaaaaccctgcttcatacaacactggatctagatgttcaggaatggatcgtttactcattacagtgattgaagcaagctccatcagtagaaacagatggagccaaacagctttgttttggctgttgttactgcttggaatgaagttattccttattactgattaagaatagagccaaatgatgtcacagtcaggtgaaccagagatagattggatactcataaataaaactgaaaacctgaaaataaatcttcctgaaaagattttgtcttacctctgtactgatgaaaatatatgatagctaacattgtatttgaacatgtgatacatactggacactatttttaatgctttacatgtattagcttgttccagtcctactaaaatcccaagaagtgagtatttaagctagaaacttatgcagctgggatttaaatgtgagtttcctggttccatagtctaccattttctatttttgtaaacatattctatatttgctattgaatatttgttgaataaagcaaaggacaccgcatattgaaataagctaccccttcaaatgaacttactagattttcctttctcccatggaccccagtaacaggtgtggtatgtgggcttgttggaacagatggaattgcttctcatctccagcactggcttgaaaagtccagaggtcaagtgcaggcttcgtccagccatggattatctatgtggcgaaggccaagggacttttcttccaggtattgtgttttggagaatagggtgattcatctctacttctcaggactcttacgaaaaatcatggaatttgttttggattctcaagtagacacagggtgttttatctgtgtttgaggtcattgtctggtcctttgacttaagtattattaggccctcacagcgcctgtagtaccttctcagcactgctgttaatttactgtagtccctggctatctctcttttgttccattactacaaggtttggctgtttgccatcaggcagccagggtaaagttctactcttgccctagatatgtagaaaatactccaagtccaaatcatgtttaagacccatggaaaagacagatatgaggccctgtgaaagggatgtagctggactacaaaggctaagacacgggtgcaacctcactgaaaggaaaacagaaatgatgacttccattgtctctccagagatggtctaactcatcatctcagattcactcctctttagacctcttaagacttttgctttggcttgactcttcgggtggaaaaatgatagacaaaactcagtgtggtatatattatttgctagccactgtcctcagtactctacacattttaattaaaactctaatagtgttttcatttttcaggtgaggaaactggggcacagaaagacaaggaaactcatttaagcttacacagttctaaagtgcttgagccgggtttcgcactgatacaacctagccacgggggccacacccttagccactagagctgtgctgtccagtagaactcatggagatgatgaaaacgttctagatctctgttgtacaataccagagccttagccacaagtgactgttgagcacctggattgtgaacagcacaactgagcaaaggcatttacatttcatctaattttagtttattcaaattgaaatagccacatgtgactagtgtctaccttctcagacagctcagccctagactatactgccctctaggaaaagtcaaggtatagagcgggccaggaagaaaagctaaggacatgtaattgaacaaatttctatcacccagtgatcagtgctgtcagcatttctcaggactgtaaaaaaaagatgttttttaaaccaactgggttaacatttctaactcaattttaatagttcccatggtagttattttattttattttattttttgatatggagttttgctcttgttgcccaggctggagtgcaatggcacgatctcggctcatcacaacccccacctcccgggttcaagcaattctcctgccacagcctccgaagtagctgggactacaggcatgtgccaccatgcctgactaattttgtatttttagtagagacggggtttctccatgttggtcaggctggtctcgatcccgaccttaggtgatccgcccacctcggcctcccaaagtgctggaattgcaggtgtgagccactgcgcccgacctccatggtagtttttatatacattataagtctgccatgtgtcctgcagaactcaaagttgtgtaatgtgtcataataaacaaagcaataatactatattaactaaaaataatgacatgcaaatatcaattaaatccctgccatacactgctttacaggcaattggctactctttttgtggttagaaagtgcattcttcctaattctttgtactacatatcttaaaatggatacagtttaggtctgcaaatgctatttccggagtcattttcacatctattacacaaattactttcccttagactacttctctgtggaaaattgtcatgatacagccgaggttccaacacagtgtatttataggtttttcagcttcaaaaactatcaaattcttggaacagtttgatatagaataaaatttccctgccctttgatttctttatttgttttataaaatttaggattttagatatgtagaatgcatgcatgctctattcttgaatcaaagtagaacattcccattatttaacttttaaggcaaggggatttctgtttttcttttctttttctctccttttttttttttttttaaaaacagggtcttgttctgtcgcccacactggagagcagtagtgtgatcttggctcactgcagcctctacccactggggtcaagcaatcccaagtagtcaggaccacagtcatgcgccaccatgcctagcaaatttttatatttttagtggaaatggggttttgccatgttgctcaggctggtcttgaactgtggggctcaagggatcctcccatctcagcctcccaaagtgctgagattacaggcccaagttcccatgcccccaccggatttctgctttctttgggcattgtaatacaccaggactggactcattggtggacaggatggctcattatctattttattatatgattttgtgggctctgggacaaaatgtattacaaaaattttcaggaaagatgtacacaaaaatatctctggaatgagtgaatggattaatgctttctaatattcctagttacatgttgcttaaatggaagaatttaaaattttttcttacaacaatccttaccctaagaaggtggaggtactgtagcctccgctccttgttacaatgggcaactgggaaaataactgaataatatgttaattccattgctttggggacatccattctgagatcactaccttaagctacaatccatcatgggaatccattatgcagcttagaactccactagactccttggacatctagctttgaagtgtacatagaaacgaacttctcctagcttcttaaggaatatagtatcttaacttgaatatttcaaacataaaagaatgttctcaaaagtcaaagactctcaagagtcaaacagatttttgactcttgaaaaggaaagtttagttacttgtctctgaggtatttgttttagttacttgtctctgagatatttggtcacctgggccttgtaatatcactgtattagtcatggttctgcagagaaagagaatcagcagaatgtgtgtctgtgtggaaggagatttatcataaggaattgactcacatgattatggaggctggtgagtccaaagtctgcagcatggctgccagcaggctgcaagcccaggagagccgatggtgtagggaaagttggaaggtagactgctggagaattccctcttgttcagagaagctggtctttttttttctattcaggccttcaagtgattgaatggggcccacctcattatgcagggcaatctgcttatgaaaagtttaccagtttaagtcttatctcattcacaaacacgctccgcattaaccaataccattaactacccaggtaatataaatgtgaagaagccttgacttgtataaagctatataattctgggataaatccagatattttttcagaaaattgttgcaattcattcatatttcttattagctattacttattaactgtgcgtattctagttgctttaaatgcctaaagcctcattgcttcaacagcctttcaaggtagatggtattcccctcatttttagttaaggacactgaagcctcaagagattatttcgccgtcagaggtaatgaggatggaatccagaaatttcggacttataggccagtgcttgtccaactctatcctctctctttccttttctgtctgttcatggcctaatcatatggacatcatgggaatcaatatctatttttactgttttatctccatcttcacttctatatccacagatttaaaaaatcataatgtatggttcttccacccatttttcctactaaaagtagtattttcacatgaaatactatttataaagaaaaatggcttgttacagggtcagttgggcagataagcatcttgagaaggtgacgtttttcattccatggggagttcagtaggcaggatgatagatgaagctttccaattatttatcgacgtgttgtatttaagagtagtaatttctaggttgcagagatgaaattccctttcccagtggtcacttggaatgggtggcattcagtataacagaagcctgaaataaccaaaaaggctttctaaatattcatgggagaaaaaaaaaagtcttacaaatactatattttaacatttagtattatctctgctcctgtaagtatttttagtttcagagctctactttcttactcaactaaatatttttgataattcagaaattaacattgttgaaattatggctgataatttctgtaggaataatagaattcttgctattaatcatttaaggtgacaagaaatatcatgacatttagaactattgtgtgtcatttaaaaatactttcatgaaaataatacatttctctaaatgtaagtgaggactttgtcccctcatttcccctgccagcacactcaggcacagcaaaaaatagcactgcccaatctgttgactgcagcagattgtcctaggttcttttgagagtaaagttaaatgtaaaaactcccccaaagctacttttttccacttttgaagcacgtttcaataaccagacatcatcttgcaattcctttcctggaaagtcatggttaaacctggaatatttaagttttgttgaaagttggaaataattcacaagtattatattcttattttcacatttcaaaattatatccagttgtatagaacatattatgtgcttggaatgtcttgtcttaggaatcaatggcacttttgtaattattttaattaataaagccattaaaataatgtaaaaaaattgaataaaaataaacatctattatgtctcattgagactctgttagacccatagctaataaagttttatttattcttttctaatgatgtaactacacatctgcatttggatgggccatagagttcttaaaatatcacaatacagtagaaagaaatatattaactttgtcaaagtgtatataattttgtttccctttatattcattgcaaaatgaattgctttcttaatggagaactttgtgtgcttttaggattttttgagggtgtccttactttattttctttacaaaaatgtttgtgatccattggtgtttatacattgtctgattactaagaactttatctttcttcactcatgaacttgtaaaatttattgaaaatatgtggtgagaactcataaggctacagtgtttattttctatttggtttcatgaattgtcatccaaacaacttagcgcagatatcagacaatttttaaacaagctgttgacaataccatctattcaaggaatgtactaaatgtgaagaatgaacaagactgtaaagcctgtcggttcagctttatctttttcatgagtttaaaatcaaacttctgaggactctgaaagtatcagccaaagacaacctcatttatttactgatttgaaggaatctttactaaagttagctcttgataagaagatgcaaggagtattagctatggttcagcttaacagcccttgattatttagtttcttagataaaaaatcaaacaaactcatatttgttttacataaaatatatgccaaacacagttaatgatgattttaagatgtaatgtaaaatttatattactttgacttttggtcaggtgttgtggttaaggtctgtaatcctagcacttcgggaggctgaggcaggaggatcacttgcagttaagagttcaaagccaggagttcaagactagcctgggcaacacagccatgagaccctgtctctaccaccaccaccaaaaacaacaacaaaaataaacaaacttgacttttagtgaaaaaactttcccaattgttaaaaaaggatatacatattttcattgcaaacaaatgagaaattacataaaaacataaaaagaacattaaaattacttcttatcacactacccatggataactccttttgatatttctgagtatttcttttaaaaatattttgtgaatgtttaagttagctactcattttaggagctttttttgatttcttagttgcatggaagggaattcaactgtgggaaaagagatatccaaatctacctcatccctccaccacatccccccaacacacacacacacacacacacacacacacacacacttaccaccaaatgcagtcttgttggtagaataagaaaagtatctcatctttatcaggaaattattgcttgttttcaaggatctatggcattttaatgattgttctttgctcaatctagtaacaattgatagtaagttagtattaacattgttattttactgcgtaggggcatgagtccatagcataactttgtggccagtgtttcaggattcctgcagaaggaaaagacagaatcacaattataattcttctcacttccagttagcattttctgatttcttatgtggttgtattaacccatatgatatatttgtgtttttgagttacgataatgaattatataaagtttgatggattgatcataattttagagttcaaatattcaaaagtcaaacaatgtaaaggaggtagaatcagatgtggcatcttagtttggactgctgtaacacaatacaatagactgtggggcttaatcaacaaacctttatttctcagagttctggatgctgggggtccaaaaccagggtgtgagcatggtcaggttctcagcgagggccctcctcccggcccacagatggccatcttctcattgtattcttctatgaaggaaagaaaaatcatttctctcatgtcttttcttatggaaactaattctatttatgagagctccaccctcatgacctaattacctcccaaaggtctcacctcttaataccatcactttgagggttaggatttcaacatgtgaactttcagggggacacatcctgtctataacatgagggtatcataatattggagcaaaaaatcacaaaaacatgtcctctctgtagcacttattaagctgcaagtattatcttcaggtgtcctctgcatttactaactctgaaatgggatgtgtttggaaaacacattgctattgctattgctattgctattgctaggtgctatgttggcatatagtgttgcatagaaaaaaagtagggctttgttccttcattcatctttttattcatatatgaatgcatgcatacattcactaattatcaagtgcctactgtgttctaggtattttactaaaaaatctagaatatgatgaggaaattgagaacacaatattttcatattttctttgaaaaaagtagtgaggagacaacatagtgtacttgaaaaatatactcagccctcagtagtaatattgattgtgcaattaaaatgtcgggtgtctttggttaaattatttgtgtttttttattttagctgagtgatcatagttcctgctctattagccattcatctggagaaacaaatgaggtaatgaatgcaagaacatttgcagaatacgtattacaacacaaatgctcattattatcaggaataacttgaaaatgcatgtgggatttatgatgtgcttttataatattttatcttgaagacatcattatttttgagttcttcagacttaagaaatattattcttaagaatattacacttaataaatattattcttaagaatgttagacttaaatattattcttaagaatattagacttaagaaatattatacttaatattgtacttaagaaatattattaagatagtgtctttaaatgactttcttcagtcgaagttttccctctagtggttgctgtggaaatcacaggaagattttctaatgctaaatgttcaaatggaaaataaacacataagaattgaaaaacgaatagccagaattattgaggaaattcgagctagtgtttttttttttttaaagactctgtagttagattttaaaattatataacagcactcagtttctgaaaattagaaagaaaattatttggtccttttatggcatcaaatggattttaatgaagatgatgattaatatatctaggcttgaagaaagcaataagaaagccacacacacttcatttcatcctataaatgaagcattttcaaatgcaggctcttaaatgattttgctttcttttttgatctggcttccagtacagcagtaatctccagttttggcttcctctcaggaagttgagcagaagttgtgcgtgaataagcatattttggtttttcttaaaggcacctttcttataaatcactccccaaatcagaaacactgaaatgtgatggtaggataaaggcattttaaaaatccaagccccagaatgctctaccaggccccaattgtctgtcctctgcccacctctgtagcctggcatcgtcctgccctgcccttgcccacagtgcttgggctgctgccatctttatccctcggacactccacagctgtgcttgcggttccctgttcttgacatgctctgcctcacatcgctggcttctatggaccacctgcctcaaaaacgtcttccctgacccacctagaaaagtaggctttgacagttcatcttcatcacatcacccatttattcactccagaactcttaccatcatctaaatagtgtaatttattttctactagtttttgtctgtctcccttagaagaatggaagctacatgacacagagatttatgcatcttttcatgattgtgacccagaccctagaacagtgcttcacacaaggcaggtgcttgatattggttggcacaatgaataaatgaatggaagatgataggaacattaactaatcagtgttatttgtttaaaaattttcctgaaacactcagttgtttttggtgccttgtcttagttgatactcaatttgtaatctttgaaataatttaacttcctcattaactttacattcgaatgaagtttaatttttttaatttttataaatttatagattttttatagatttagggggtacaagtactgttttgttacgtggatatactgcatagtggtgaagtctgggcttctaatgtaactagcatccaaatagcgtacattacacatttagtcttctaagtctccagtgtctattatttcactctctatgtccattacttatatgtgggaactaagtaatatgcacccgtattacttagttataagtaatatgcacccgtattacttagttgtacgtaatatgcacccgtattactgagttgtacgtaatatgcacccgtattactgagttgtacgtaatatgcacccgtattactgagttgtacgtaatatgcacccgtattactgagttgtatgtaatatgcacccgtattactgagttgtaagtaatatgcacccgtattacttaattataagtaatataacttacaagtaatataagttatattacttataacatatattataacttatattacttataagttatattacttgcaacttatataacatgtttcttataagttatattacaactaagtaatatgggtgcgtattacttacaactaagtaatatgggtgcgtattacttacaactaagtaatatgggtgtgtattacttacaactaagtaatatgggtgtgtattatttacaactgagtaatatgggtgcgtattacttagttcccacttataagtgataccaggtggtatttatttctgtttcagatggggttttaaaaagttttacaattctttatagagaaactctactatggaaacactaaattaaatatttgtttgtactaaacaagaacatgatgcttgttcatctcctttaataaattcaattagattacacagcttatctagtgatacgtgcagtttcttatatctgtacagtaagaagttattccagaaattaagattgtttttctgaaatttatattgtttcattctgctttgttttccgtagtgagataattgctgttcacactcacgtacttggcttcgtcacagagtcttttctagcctcaatgaataattttttttaaaaaacacccttttctcaaaaggcttactttttaaacctttaatcagttttgactgatcttctcctttgaaactgctctaattatttctcataccacttgatggtttggggaccgaaaaaacaaaaaacaaaaaacaaaaaaatgtacatgaagactaatgattcgaggtctctgaaactgagacgtctgtatttatgtctgttgaagactgcagtcggtaaagcctacaaaacgcattattaggaatagtgttgcgctggtttcctttgtattcatgtctgttgcctgctaatctgaatttgtcgtccatgccactaagagtcaagcagttttgctgaaaatttgtggccaaaaggcaaaagccagaaactgtagatttcttacttgagtgttctgctccgtcattttcttcatacagccctatgaaaatgagggagatgtgcagagattgtaatggtattcccctgataatactgttaagagctgtatgctctccatatgtggtaataatctgtgtctgttctgtcttgtacgtgtgtgtatatgttcaaggaataatgtattttaatctatgtaaatgaatgataagaattggaataaaaatcagtatgcattttatagatagttctgtttattacaaacacttaaaaagaaagatgaaatgcagcttatccctgacttactcgggctgtttccttttgcactcatgctttcctgctctcgttaccatagttactggtttaatcatgatgcacagaacaatttctaattacagtatatgccagcacaaaaattaattctttgcatatcttaggccacaaacagcttgtagcttgttttttggcactttattaccacatataatgaaaaagacattggtacataattttaaatctattattgtctgctacttgttatcgaaatgaaaataagcttctagaaatggttaaatttctgaacattgctctcaagactaaaccaggaagaagtcaaatccatgaatagaccaataacaagttctgaaattgaggcagtaattaatagcctgccaaccaaaaaaagcccaggaccagacagattcatatccgaattctaccagaggtacaaagaggagctggtaccattctttctaaaactgttccaaacaatagaaaaagagggactcctctctaactcattttatgaggccggcatcatcctcgtaccaaaacctggcagagacacaacaaacaaagaaaatctcaggccaatatccctgatgaacatcgatgcgaaaaccctcaataaaatactggcaaaccgaatccagcagcacatcaaaaagcttatccaccacaatcacattggcttcatccctgggatgtaaggctggttaaacatatgcaaatcaatacacatcatccatcacataaacagaaccaatgacaaaaaccacatgattatctcaatggatgcagaaaaggccttcgataaaattcaacatctcttcatgctaaaatctttgaataaactagatactgatggaatgtatctcaaaataataagagctacttatgagaaactcacagccaatatcattctgaatgggcaaaagctggaagcattccctttgaaaaccggcacaagacaggcatatcctctcacaccactcctattcaagaatagtattggaagttctggccagggcaatcaggtaagagaaagaaataaaaggtattcaaataggaatagaggaagtcaaattgtctctttgcagatgacatgattgcatatttagaaaaccccattgtctcagcccaaatctccttaagctgataagcaacttcagcaaagtctcaggatacaaaatcaatgtacaaaaatcacaagcattcatatacaccaatgacagacaaacagagagccaaatcatgagtgagctcccattcacaattgctacaaagagaatacaatacctaggaatacagcttacaagggatgtgaagaagctctttaaggagaactacaaaccacttctcaaggaaataagagaggacacaaacaaatggaaaaacactccatgttaatggataggaagaatctatatagtgaaaatggccaaactgcccaaagtaatttatagattcaatgctatctccatcaagataccattaactttcttcacagaattagaaaaaaaaactactttaaatttcatatagtacaaaaaaagaacctgtacagccaagacaatcctaagcaaaaagatcaaagctggaggcatcacgctacctgacttcaaactatactacaaggctacagtaaccaaaatagcatggtactggtaccaaaacagatatatagaccaacggaacagaacagagccctcagaaataacgccacacttctacaaccatctgatctttgaaaaacctgacaaaaaacaagcaatggggagtggattccctatttaataaatggtgttgggaaaactggctagccatacgcagaaaactgaaactggaccccttccttacaccttatacaaaaattaactgaagatggattaaagacttaaacataagacctaaaacctcaagaactctagaagaaaacctaggcaataccattcaggacataggcatgggcaaatacttcatgactaaaacaccaaaagcaatggcaacaaaagccaaaactggcaaatgggagctaattaaactaaagagcttctgcacagcaaaagaaactatcatcagagtgaacaggcaacctacagaatgggagaaaatttttgccatctctccatctgacaaaggaataatatccagaatctacaaggaactgaaacaaatttagaagaaaaaaacaaccccatcaaaaagtgggtaaaggataagaacatacacttctcaaaagaagacatttatgtggccaacaaacatatttaaaaaagctcatcatcactggtcattagagaaatgcaaatcaaaaccacaatgagataccatctcacgccagttagaatggtgatcattaaaatgtcaggaaacaacagatgctggagaagatgtggagaaatagaaacacttttacattgttgttgggagtgtaaattagttcaaccgttgtggaagacagtgtggcaattcctctaggatctagaaccagaaatacctttgacccagaaatcccattactgggtatatacccaaaggattataaatcattcttctataaacatgcacacgtatgtttattgccgcactgttcacaatagcaaagacttggaaccaacccaaatgcccatcagtgacagactggataaagaaaatgtggcacatgtacaccattgaatactatgcagccataaaaaagatgagttcatgtcctttgcagggacatggatgaaaccatcattctcagcaaactaacacaggaacagaaaaccaaacactgcatgttctcactcataagggggaattgaacaatgagaacacatggacacagagaggggaacatcacacaccagggcctgttgcgggaggtggtggggttaggggagggatagcatttggagaaatacctaatgtagatgacaggttgatgggtgcagcaaaccaccatggcatgtgtatacctatgtgacaaacctgcatgttctacacatgtatcacagaacttaaagtataatttttttaaaaaagaaaataagcttctaaagtggattgatgttaaaataactaataaattttttttaaaagatgaaggcttattacaaatgagacgtctctagtattatccctaacatattaattaatatgcatttaacaattttttctctccaaaaacattattaaaatgatgttcattatttagaaaccgaaattgttagatttctgtgactaagcagttgagccagaaaccagtatttgagcactcacattttccaaactatggataaaataaacattaaaattccctgtgttgaaagtctgaagaatcttttatatcacttagtaaaaaacagtatttcttaatgtttgttaagctcctgtacgccagggacactagtaatttctcccaacatcctgccatgaaatggaagaccagccagagtttaatctggctttttagctcctatttcagtatttctaacttaactgtgccaacgtagttaaagaagatatacctgggcacagtggctcacgcctgtaatcccagcactttgggaagctgaggctggcggatcacaaggtcaagagttcgagactagcctggccaacatgggcaaaccctgtctctactaagaatacaaaaattagctgggtgtggtggcatgtgcctgtaatcccatctactcaggaggctgaggcaggagaatcgcttgaatctaggaggcggaggttgcagtgagccgagatcgcaccactgcactctccagcctgggcgacagagtgacactccatctcggggggacgtgggagaagaaataaagaagatataaaaaatgttataggtatttctattcacttttactataatttcatagcagagcagctgttataaatgaaatatcaacaaatttttaatcaacaatagaacttttagagtattagaaatttttaaacttttctttgcattttgattaatatgatagtgctattattactattcttaaataaaatatattttactatctttctgcctaagtaaaatatttgataataaactaaaaaatgcattatttttctcataaaattacagtataacacttcccaaacctataggtaagttttctgtgagactgttaaaagtaatttttattgtagattgttgtgatgctgctcccaaacatatctgaatcatatttacgttggctaacatgagaagatacacacattttcaaaaagaatcaatgtacggtgcttttatgactcccctgactccaagtcaccttacctattttattattgctagtctaccaggcatttttaatttcattggtaaaaccagtcctgatacaaaatatatttgtattataaaataataaatgaactactgcatcactatttaatcactatttatgtttctctgtttcttccttaactggcatgttaagatcttcatggcatgtatgcattttctcagaaatattatatgtagtctggaaccaggcgctatggttctatttgtgcttatggaaaaacttatgattgccaaatgtcaggtttttttttttgcttattaagagtgaagcagataaatgcaaaataaaaacttgaaaaatttcctgctattaggatttaactttttcttgttgcttctgttgaaagtcatcatatcctagttctaggtcaccatatacattcattcatatgtagtttattacaaaatacattttaacttctagctgaattttcttctgactttttccatctggtaggcttatattacagttaatggacacatataatggttatattatgttgttaactgaaacagctataaaattagtgaactatttaattgccatttaaattggtgaagagtggcctctctttaattggggaagatgtatttattggatttttatttagtacttttaacttgtctggcagcaaatgtaaatcagccaggaaagcataattctattaaatgtagctgtactgctttaagagatacaaaaatctcttaattcagataacagattttacatcaggaagtgtacagattactaaattattcacagttctaaatactccaggaatgaaactgtagacaaagatttgaagactgctacacgagcttgcctattgttttaccccctcagggctctttggccctgcagcagctgagtagtatttattgtatttgctggaacaatactgggtcttccttgcattcattctgaattcaaactctagtccagaggggtgatcgatataatttagacttctatgcagatacccttaattggcaattataaacaggattcacatctttaggtatggcatatttcaaaaccagttttcacccttttttgtttatttatatttagcattattcttttggttactagatagcatttaaattacagaatgaattaaggaaaagattgattatggattttggcaaaagctgtaacactgtttggtgaaaccttagaatgtaatttgtttctaaaatcacagttgactttagtctttttcccatttcttattgatacataatattttacatatttatgaggtatatgtgtttgttccatgcatagaatgtgtaatgataaagccagtaaagccagggtacttggaatatctatcaccttgagtatttgtcatttcttttttttttttggttttactttaaaaaaatttttattttactttaagtatctgacagaggtctaatacccagaatctacaatctgttattatgtatccttacataattaaggattatgtacaagaaataaacaaatttacaagaaaaaaacaaccccaccaaaaagtgggtgaaggatatgaacagacacttctcaaaagaagacatttatgcagcccacaaacagaaaaaaaagctcatcatcactggtcattagagaaatgcaaatcaaaaccacaatgagataccatctgaagccagttagaatggcgatcattaaaaagtcaggaaacaacagatgctggcgcggctgtggagaaacaggaacgcttttacactgttggtgggagtgtaattaattcaaccattgtggaagacagtgtggcaattcctcaaggatctagaaccagaaataccatttgactcagcaataccattatggagtatttgttatttctatgtgttgggaatatttcaaatcctctcttttagttactttgacatgtacaaaatattattgctatgtatagtcaccctattctgctatcaaacattagaacttatttcttttctttatgtttgtacctattgaccaatgtcaaaatcattttaataatgtaataaattatttatctaaaaaatattgagagtgagcctaagatatagaaagttaacactcaaactctatgtaatccattcacttgaggtcacgtccatataaataactgactatcaactttagaattaaatagggtggtagaaagtcacctcactagcctaattacattattttatttcagcttttgatctaagtggcacttgtaatttaggtgctttttgttttcattgtaaaaatggactattcatttagcttaattttgctctcaactttgtgtttttactttaatatttttctaatagccagatcttttttatattttaatttaaattaattttaaattcaacattgtgaatgcaacttgtttaaaaaattcaagtaaatatataaaatagaatagtctccttcatatccttacaacatttcacctctcccattgtactctccaacccataggtgatcactgttttcaacatgctggatactttaaggtttcattctatttattcattgacttgttcattcattaatcaaacattttaagtactatgtttcatgcagagtatcagctccatttgtacatgtcggaaacttttgtatacttttatgacatgaattgagtcacactatgcagcttgttctgtaacttagttttagatttatattttcagtaagttttttcatagaggtacatattgatagaactaatttgcatcttaaatgcgttaaagtgcattaaagactgcatagacaacataatatgtatgtaaactagtgtatttaattgaggggcatttgagttgattccttttaatttactatttacaaagaatgctacaatgaaaagtttgcccttgaatgcacatatgtcagtatttccatagagtaagtagacttctaaaagtgaaatttctaagtcaaagaagaagcacattaataattttaatattttgataaattgccatctcccaaaactactcccatttttaattctaataaaagaaatagtggtttctgttgtctgtacccttgaaagtgctggaaaacatcaatcttatttataggtatctgaggaaaagatataatttacatttgttttaattttgatgtgatcttccatctctctaaactccacaatagtcaagatgaaggaaaaattttcacatattactggacatttttattttttgtgacttctttgtttatattgtttccttattttattatttacttacttgcctttttattatttatttttaagagttctaaatatattatggatatgaaccccccactacaatttaccacgtagtttctctgagtcttgtgcttatcttttagctttatggtatttttactctacagatgctttacgtttttatgggttttttttcttcaatttttaaaaagtattgcttctggtttgatatcttgttaggttatacttacatatcttgacattctgaaatattcttttataaatgttgctaaatctcttaagtgtgctttaacatttagttatttatttatgaattcataaaatacctattgaatgcctgcaggctgctaggatttgtgtcagatgcaatgtagagcaatcccaactgctctctgggtaactatgttctagtgggctaaaggactggcatcacatatgcagtttaatgcatgtagttacacattgaggaaagtgcaatgaaggaaaggtatgcctggaaattattttaattttattatataacaggaatgtatagttttttttttttttttttttttttttttttggagacagagtctcgctgtgtcgcccaggctggagtgcagtggcgcgatcttggctcactgcaagctctgcctcccgggtttacgccattctcctgcctcagcctcccgagtagctggaactacaggcgcccgccaccaagcccagctaattttttgtaatttttagtagagacggggtttcaccgtgttagccaggatggtctcgatcacctgacctcatgatccacccccctcggcctcccaaagtgctgggattacaggcgtgagccaccgtgcccggccgttttttaattttttttatttttttttactaaatatttagtcattatattctattcaagttattgcatagtgtttcatggttcattgattttaaaactcaaacaattgctgtaacaaattaacatctttcttaattttattaaatcaatatcccctctccttgcactttttgattattattctttggcagtctagaacacttactcttgaacatccactataaatttgcttgttatgttttacaaaacttataaaattataaaatttttattggggttatattgaattgatagattaactaggggagaactgatatctttatattaatgagtccttgaattcaggaatatgatatttattcaaatcattttattccttgtattaaatatattttctcttttgtatttttcttcataaggaatatatttgattttagtatgttggtattgaaaatggggatttttttaaattctaatttttctgagtatttcttttgttccagtagtggttttagaaatctaagtcttttaatgggttagaggtggcagtagagaaagcacagaatattcagctgggcaggacttctttactatttttgggtaacttcttttttggacattgacagtctgtacttttggctgctgtaaatttccttaaacagtgtcctgcctctctttcctcaaagttgagtgagaagttcctgacagctgagataaccaaattcaatgggtctaagggacctgccacctaagagttcagaggtagagaggtgggaaggtgaagggaaggctcttttgaagcagtagaacaggtaattccagattgatgagtcacactgtccaaacatcaggttttgctattggaactcagaattaaatcacattactgtgctctaaagtgcaatacctagagtagagggtattttagtaatgatatcatccacattaaagtagtcaagatatgcatagggaattaaataagactgagagattattattccttcttaaataacaaacagttcttaatattaactttcgaattctgtgcttggttgtgacctttgaacataaggtagggatttgaacaacaatttaattttatcattattgtttttaaggatatacatgctggcttagctagttgtaggtggcaatttcaaaaatggggctacactttcaagctaacctagtcagtatgaagcaattgatttgttatacaatttgttgttatgactggaggcataaatgagagcttcagcattataaatggaaggaaaataaattaaatgtgattgttttattaccctcgcgttctgtgaaagagtatctgaaagcatttatagaaagttaatttcttttttatatttatttttattgagctagttaatttcaaacaccccataaattttagaaccaaaaacaaacactgtcacatgccctggaacaaaatacattttagtgttagaacattatcactcgaaaattatagtgccaacatttattgaaatgaatatagtctatgtaatttttcctacctcttcagatttgggttatattttagagtgtttgagtcactagaacttcaaattaataacttaagtaaatgatttcgtttttaaccagtaggtaaattatttatttgatgtatataggcatgtggctaatgtatggtttctgagattcatggctataatcccttttctcttaagcgttaattgatgaaagttggggaatcagtggtttacaaaagacagtaaatattttaaaattaacatttaaagtagtcgactttaaggaggaaaaatttacccacaatggaatgcaaccattttaagcatagcgtttgatgaattttgacaaatgtgaaacccatgtaatcatcatcatccctcagaaaaacccttttattctttgctggtcaatccaccccaaccctcaactacagattggttttgcctgctgtagaatttaatataaatggatgtaacttttgatatgtggtttcttttactccgcataaagcttttgaaattcatacatgttattctacgttttaatagcccatttcttttaaaagatgaaaagtatcccattgtatgtattcacagtgtatttttccactcatctgttaatggacatttgagttgtttctattctgtgacttctatgaataaaacttctggccgggcgcagtggctcacgcctgtaatcccagcactttgggaggccgaggagggcggatcacgaggtcaggagagcgagaccatcctggctagcacggtgaaaccctgtctccactaaaaatacaaaaaaaattagccgggcatggtggcgggcacctgtagtcccagctattcgggaggctgaggcagaagaatggcatgaactcgggaggcggagcttgcagtgagccaagatcgtgaaaaaacaaacaaacaaacaaacaaacaaaaacttctaagaacttctaagaacattacgtgtaagtctttgtgtagtcataaattttcatttttattcactatcgacacaggagaggagtgtaactgctaatcatatggtaagtctatgttttactttttaagaaactgctgcactgttttccaaaactgtatcattgtacatcctcaacagcagtgtatgagacttagtgttactctaatatcttcacttacaggaagtgttgtcaacttttgaattttaatcattttagagggtgtttagtggtatctcactctggttttaatttgaatttctctgaagattggagatattgagtgtctttttatgagcttattgatcatttgaagtatcccatccttttgcccatttttaatggagtttttttttgaagtattccatccttttgcccatttttaatggagttgttggtttttttatgattagtatttgcttggtgtatcttttccaatctttcactcttatttatttctttatataaagacatttcttgtacaaagtatatagttgtgtggtgtttttttatagactgacaatttacatttttatttgtggtcttcatgcaatgaatatgactgtaattgatagcataagtcctccctcttgtttatttcatgtaggtctcatctattttttctttattatatacttatctcctgacttttaggttaattaggtatttttaccattctcttattttcttatcaaccatattttatttttagttttagttttttagtagttgctccagaattccaaatattcattttattacagtctaccttcacttaatatatatcttcatgtatgatataagaaccataaaacagtgttcttctattctacctccttctctttgtaaaattgttaccatgtattttctttctatacatgttataaatccaaaatattttgctattatttttgttttaaaccaccaattatctcatcaataaatattttgaaatgagaaaatgcctttaagatattgtcttaatttgtttgtatagccataaaagaatatttcgaactgggcaatttataaagaatggaaatttattttctcgcggtaacggaggatggaaagtccgagatcaaggcgctcacaggtttggtgtctggtgagggctgctctttgtttccaagatggcgccttgatgctccatcgtctggagggaagaaatgctgagtcctcgcctggcagaagatggaaggcaagagggcagagcattgtgtgcagtcttgtttataagagccttaatccccttcatgatggaagagccctcagggtttaattacttcttaaaggccccgtctcctaatactatagtactggcaacacctgcattttggaagggacacatccaaacaatagcagatatacttccatacttatcattcctagcacttttttctttcctttttttttctttttttttttttttcctagaggcaagatctcactctggctcgcaggctggagtgcagtggcacaatcatagctcactgaagccttgaattcctgggttcaagtgattgggctcctgcctgagcttccaaagtagctaggactacaggcatgcaccaccatacctggctaattaatatttatttattattttttgtagctgaggtcttgttatgttgcccagactggtcctgaactcccagcctcaagtgaacctcccatcttggcctcccaaaatgctgggattataggcataagccaccatgtccagcccatttttagtactttttattccattatgtagacatgcagatttgagtttatctactctcattgcataattctgctatatatatatatatatatgtgtgtgtgtgtgtgtgtgtgtgtgtgtgtgtgtgtgtatattttttaacacatgtctgtcagaaatggactcttaaagcttttgtgtatctggaaaagtttttattttgccttgattctttaaatatatgtttccctggacatagcatttgagattgacagtttttttatttcttcaacattttaaaaataatgttttgttttctcctggattcaactaatagtaaaatatagagagaaaagtacaagtcatctgagttatcatctataatatatttagaattcaaaatatgggtttgctcactggccaaacttctacactgcaaggcaaaaagtgtcaaaaagtgttttagaaaaacctttggtgaatgtaaaatatagagagcatctgggaatgtgaggttgtaggatttaatttctgtggcttagactttagtagggtttatctaatatttatttaatatttttctaggtcttagtttcttcatgtgtaaaatgggcacaataatagttattattcatgggaccactgcaaagattgagatatgagaaataagttcttagaactgtgcctatctcaatctcagttcccagttaatattcactatgatgttgatgacagtaataatgattaccatacagagacactgtgattattaatatcacttgttatgttgcttttaaaattagatatgatttcctgtctcaagaatttggcactttgctaggaagagctaaatgccatcttcttagcaaatcctaataatggataattatcctaaataatagataattaatttatgtacatgtttatgccaggtatcgtgtaaatgtcatacatagtgccacatagttatttataaaaatgtcaatgatttaataatatattgtgccaaaattatgtaatattaactgagaagaaataaaatctgtgtttagaaaacaattatattgccttcactgtttggtatgtgggaagaaaggaatgctcattttatctgcaggaaaaatgccaggattcttgatagaagtcttcaaattatttgaatagcttttatccttaagaattcaaagggattaaaatgagaatcagcttttgaggctcaaaagaacctcaccaagcaaaaaaaggttcttataaaactgaaattcagagttgagtataattgtctaaatttagcttgtgaaatgcataaaataagctgtataatacccaaaatgctccttagaaagatgagttcatgttgaaacttaaaaaaaacaacaacaaaaaaacccccccccaaaaaacagatgaaaagcctctaaagattttttttttaagtttaagcttatgttatgcttttcgttgttgctctggtctcggctaaaatttttctctttaaaaagaagaatattaacatggaagtaatcttgactataaaataaacttccctggcagttttgttttgaaactgctaatgctgtttccaagcattttcaaaaagcacaatttttacagaatgttattaacgaaagaagatgccttgtttgagagcgacttaatgttatatctatgtttgatgactaacattattcatctctggagcttgcatggcatgtccaataaaataaaacaactgttgactgtgttgagaacaaaaagaaccagagaaaagaaagttaagattaacgatttttagcttttcctttagctatagggaatatataagttctttggagacaggaatgagacagaactaactcttcatattaaaatatagtttggtttaaatagtcccaagacaggtacaaggctgtgatgtatctgagagatcatatttcttctaccactgttggatatcttcatcatcctccttctttgtgtgtttctatctccgaagggcttatcacattatgctttataatttaatagtttatatacttctcccacttactaaactgaaagcatcaacatgttaggagtgttgttttgtttatatttacacctattggattaactaatatgcccaaagccctgtgtacattttttgagggggaatcattgactcataacagcatgatctcattctatttcaaagggaaacgtttgaagagtgaaggagagcagcaaggatagatttaggaaggagtaatattacacctggcaagtcgtatacatgcctcatccaatcaatatgggtcaggacagttttacaaatgcagaaccatattactttatttgtattttaatcactgagtttatctttgttttacacatctttccaccagtgggaatgtattcttcagagagtaacaacagagcaatagacctgtaacaacggcccctataacttccaaagtacaaagtactcctggcgttgagcatgaactaatgaggtttcattatgaggcttagttttcaaaatattttgactgagataggtgatatcaggcatataaggatgttcctttttgcttatgaaagtgtttaaatacagaaaaaagtaattagagttctaaaattgaagcctgctattttgttccttgtcatagggcggtaaacttaaaattcactggtttttctgagcttttaaaactttgtttctttcttttacttcatcacagctctgaatctattgaaagataatgtgtacttatttattccacataaaccttagatttacagcatgaggtagtctcatctgagtttcttttgcatctgtcacttaataaagtaagtgttcctcaagatatgaatattgttgaaatgtgcttaaaatgtattctcagacaactgtatccatgcaaattaatcaagaatataaccaagtcttttcagtagagcttcattactttagttttcagagtttaatactaagtagaaatgtctatgataaacctgagtactttggccaaactatactataaaaccaagtagagcaaaatgtgatgaataaagattcaacatctgtttatattctacctcttttgcatattataatctaaacagaaaaacaaaatagccaaaagtttcatactgcgtttcttggtgcattttcagttctctgcactgcccaccacatgccagccaggcctactgcagcgcccacttcgttgggcagtaaatattttctttctgaaatgactctgcaatacactcctcttttgtgccaagcccttatggatgatatttcaatttccattacttatttttggctggagaagtggtagtggaagtggggagtaatgttgcagtcttataagcttgtaatgcttgttatgaaaccatttagccaaggcaccacgtgtggacaagaaaaagagaaaacagctagataattttcccaggtaaaggcttgtatcgctagagcaagcttttcccacataggaaattttccagactaatgcctttaaaactgtaatatttcattccatttattgcaacattcttgtcctaagtctcatcgtgttaatgagcaggtttatattattagaaggcattctgtaaacatttttgcaataagtcttttcaagccttcaggattcataaaagagaaaaatgctcacttccggacacttattttataaaggaaagtataagtgtatgaaaaataaaaatctcttctgttttattaatctattttctctctagaaaccactgcagtttcacgtcctccttaaaaaataagaataatttgctaaataacaatgaccctctaactccaaaaccagttaaactaaaggcaagaagagtctttaacatttagaaaaaaaaatccagtagaaagaaagaaggttcattagcatgagatgagttatatctttattcttttttttctttttgagacggagtcttgctctatggtccaggctggagttcagaggcgtgatctcagctcattgcaacctccgcctcgcaggttcaagccattctcccgcctcagcctccggagtagctgggattacaggcgtgcaccgccacgctctgctaatttttctattttttatagagatggtgtttcaccatgttgtccaggctcgtctcgagcgcctgacctcaagtgatccacccaccacggcctcccaaagtgctgggattacaggcgtgagccaccgtgcctggccgaattataccttcattcttaaccagtactctattaagtagagctaactatgaacaaggcatccagtacagtttgggataaagcatgaggatatgtgttgggagacgtaggtctagctcggccactgcacaacattgtgcaaggccacaggcctcagctttccttttcagggaatcatacgtctcttctagctattaaaaaaatgccataatctgtatttaacatgtactagctactcttggacttctgtttatagtgaaaacacagctcacagtgactgtggaaaccacattccttgtctgtacttgaactgtggtcagtgaatagttcagtgctttcagaaatgactggacatttcttaatagaaagaatcattttctcaaagccgtgtccttccgtcctaataggcagtgtcagaagacaagctatacatttcttgtgttggtctccaaacttaactttttgtgcactctatgagtaaaaacattttccacatgcatatccaacaggtgtacacttattttaaattatacacatttatgtggattattaaaaataacaaaaaccaaattagaaaagcattagataaagtgaacaatattttaaatagtattttattaacagcatgggcacctatttggttttactaaaatactattgtaagtacacttttaattgaaagcgaagtgactaaataagcttctgcatataggaatggttaaggcactgatttgacgatctgactctacgttcaatttattttattatatagttattaaaatcaaaattagtactctttcaatttgcatttccctatgaaaaataatgtttttgaattgtcaataatcactttctacatgttgaggttcctgtaagcttagagaaaattttgctaaaaggaacatattcttctaatattttcatattgtaaaataataaatatttcagctaaaatattttacaaatactatctttgtgccttgattcagagtaattttcttggacaaaaattttcagattatcatattagaaaattgtcatatttaaatttgtcaaaacttgattattttgtcaaatttcaacaccatgtaattgtaggtcatctcaatgttattttaatcttatacagagtataaaattatccagtgaaaaacataagccctattgaaagattcttcccacaatccaatatatttctaaatacagagaatttaaatattaaatcttaaggcacatttgatcttccaatttccttgatcttatgcgtgtttttctgttctagcctattcctagtaattgcaattgaccccaaactgtaaaagccagtgtattttttggcattccttttattggatactttgaataaacatttgccagtgtttttgaatgttgttaattttttagtgtttccatgttttaaatgtgtttgaatttaaaatatagagaatttgtggccaggcacggtggctcacgtctgtaatcccaacactttgggaggccaaggcgggcagatcatttgaagtcaggagtttgagaccagcctggccaataaggcaaaactccatctcttctacaaatataaacattagctgggtgtggtggcaggcacctttaattccagctgcttgggaggctggggcaggagaattgcttgaacctggaaggcagaggttacagtgagctgacctcacgccattgcacttcagcctggatgacagaatgagactctctctcaaagaaaaaaaaaaaaaaagaaaagaaaagaaaaaaaagagaatctgggtataaatacatacacatacacatttgtaaattttgacaactacagctgtattttgattactacaatattagtacaatattgaaactagaaactagtttggatgcagttatgaattctaattcatctcagccacttccaaatacatgtattaagaacattgattttattccaaagctatactacaataagacttgtattcacattatcaccataaaagcaaataattttttgtcgatgaacattttaactacatttacgatagtgtttaccattatatcacgtttcagtttcagcagaatgagcttgtaagagctttattttaaatatgtaaattagatttaaaattcaaatcattttaagaattaaatttaactaattttctatttttatttctatgcttctacttgaagcatttatgacacaggattatttaactgcttttgaagatcatttgctaaatggaagtaacaaatttatagctcttcgtatgttcacaagaaaacttggaatagaataatgcataaaattaatctagaagtcaggcacttgatgtaaatgcaaagtcgcactccacagagtgatgtgtaaacacccatttccagtttcacatcgtaaatcattgtattccgttaccatcttcataatataactgccagacttttaaaaagttgctgattcttcctcagtggttgtgtgtttctgattttcatgtgatcaggtatagtaattattatgatccctggttgacaaacactttgaaaacttacatattcattattaatttctctcagatgataaatggaagtgtggtattaatattttcattaaacatgaacttaagaactaatgttctttacaaaattaaaaagctttcccaaaataaattgtataaataattgtagatttgcaccacacaataaatgacaaaaccactgtagcacaagtatttcagacttctctcttttttttttttttttttttgagacagattttcactctgttgcctaggctggagtgcagtagtgttatctccactcactgcaaactctgcctcctaggttcaagtgattctcctgcctcagcctcccaagtagctggaattacaggcgtgggtcaccatgactgactaatttttgtatttttagtagagacggggttttgccattttggccaggctggtctcgaacccctgacctcaggtgatccgtgtgcctcggcctcccaaagtactgggattacaggcttgagccatcccacttggcctcaggcttctcttgattcgttctcaggcagaagcactcagccttgatttccctcatatatttcatatacacctcacctatcctttcccatattccttacttatctctctgactagtggcctgtctgctgtgttcctttcgcagtctttagcaagggccacagcacctttgggggttacaatgtgtggtcggaatggcaggagcatcaaagcattctctcactgccactttggtctgttcctagaaaatggtgtccggtgtaattctttttgtctttaattatactgcctgctgtttctgtaaggtgatttgagtaatatttcatttggcgaacgtcagcaataaagacaggtcactgctaacctttagatttaagcatgtgttaaaatgagagctctaattgttgcataagattcccacacgctactaatatggtcgtgtcagaaacaggaagcaggaagtagaaagtagagagctaccaaatgcatctttgcttatttgagtgcaactattaataatgattatttatttgaaaggaaatacctaggacaaatactcgaataggactattctaggcaaacctagatgatcccaggcaaatcaggaatgatgaccatttttactcttcatgcttgttgtcttatgatatcaagatggctgaggcaatgccagccatgaggacttgattcaaaagcagaaagatgagattgggcatgatggctcacagctgtaatcccagcactttgggaggctgaggcaggaggatctcttgagctcaggagttggataccagcctgagcaacatgatgagaccctgtgtctacaaaaaatacaaaaattagctgggcatggtggtgcatgcctgtggtctcagctacttgggaggctgaggtgggaggatgacttgagcatgggaggcagaggctgcagtgagccaagctcacgccactgcactccagcctgggcaagagagcccgatcttgtcttaaaaacaaacaaacaacaacaaaaaaacacaaagcaacaaaaaaaaccccaaaactgcaggaaggtgagcatggagtattggaggcttggaaccttcccctccatcaccgacttctgctcacacttcatctgctgatgaggcaggtatatgcttgcctctcactattcaatgtgtgttactttcccaggtatctcgtagccagaacttgaactctaaattcaatgtgctcatacacattcccatggctctctacctttgcagtaaaatattcttctaaagaaaaaacactctcaagttgttaatcttttcacttgtatgttgtgtatatatatatatatatatatatatatatataaatcatgttatgaaatgtcagggactataaagattgtctttgacaaagtttgtaataactgtttaacctataccttagcaaagattcagcatttatattttctagaaaaagatttataaatcaatttttatatgaataatatagtatctacatatgaagtcatgttattatgatatcctagacaaataacaagcgtggattatattttagttaccagtacagataaaaatgagctacaagatgtactgattaaattatagggcaattgtagtgggcaatgatgtgtttctgtttataactgctaatacagtatctcttttcatcagttaatgaaatgaagaaaagataggaaaagaaaagttgaaagctttttcatattcaattaaattttatgttaggtagatttaaaattaccagtagctagagatttttgctttagagtttgtcagagttttataatgtaagtgttactgtaagccccaaataaactcatctttttccagactttgacttcattccactagaagggaaatcaaatgagctagtttcatctatgtagagatgttcaaattgggcttcttgaattgctttcttccttttatttcattataccaccttggaaaagttttcatttctccaatatcagatttcttctttttggtgtgagtttcagagcagaggtaagtctggaagcctttgggaacctttccagtttggcttctatctacatacaagaataaggtaatttgtacttcctgactaataccttaggatctttgagggctctgagataattatggagctggactaatatcaggctgaagagtccaagggaacttttagcataaagatgtggaggaggtaaaaatctattaatgtggactgattgctgacatcaggatactcaagaagaccattgtgggacttataggacatttgggtatcattatgtgttaacagaaattccctaaacactgctttagcttggagaggaagctaacatgaattgagggtctaacatgtgtcaggtatttcacattaccttttctcttacaatcttcacattaacccttcacattaatcctgatgtattagaagctccattttacataagcatattttaccccacattatgaatcatgtaagtattaggtaggcaagcaggatttaagctcatctctcttggtcttcaaggcttgtgttcagttaccacacaaactgggtcttctattactccctgagaagcagattaccctcccattctagttctagtgacctggattattgcccaagagaaatgaagtactgaagaaggacagccatcctatatagacttcctgtaccagctgtataaggctaatataatttgtgttgccatttttgttagctgtttttggaaatatggtacactccaataagtaaatgtaaaattccactccaaaaacaaaggcaagaaagctagtgcagcaaacaaggtgatggctcatggtcaggatttgaatactttctgtggtgtaaaatacatctcactctattcttgcatacaaaactggattttcaaaatgcattaaatttactgaataaacaaaatgaaggcataattctattttttcctaggaattatttgatgcctttgctatttcatcttatttagcaggttatgattatgtaatcttatttatatttcattttttttctttgggaatgatggtccatgatttttttttggcaggatcatgcgtggatttacttaaagactctgattaaaatactgaaattctctatccatatatgaacaaaattatgtttccactgtctttttcagtgctctaatgaattggaaaaagtgcatacagagtgtataagaagcaaagccaaatttgacatttaagtgaatttgagattaagtgattgagatggaatattattttttgagattagataattgaagattggagatgattttttttaaatagatcacactgaatattaaaaaggaagattctgaatcttttgttattgaaagttattaataattaagttgacactataaagatttcagtgttaaaattaagttgacattataaagatttcagtgtgaaattccaagtaatgtgaaatatcacattaaacatataaacagattggttaaagataatcctaattttcttcatgatggaaattattttcttatttataaatatactactactattggagttatgtttcctcatctattgtagaagcatatgctttgacaatgttctgatgcaagaacatatttataattgatcacacatgtcaatataattcaataaagagcaataatatttcagagacttttagagtatattcaaagcattttttttttttttgagacagattctcgctctgttgcccaggctggagtgcagtggcacaagtgagccaccaccgcctcccgggttcaagtgattctcctgcctcagccgcctgagtagctaggattacaggcacgcaccaccgcacctggctagttttttgcatttttagtaaagacggggtttcatcatgttgcccaggctagtctcgaactcctgagctcaggcaatccacctgcctcggcctcccaaagtgctagtattacaggcataagccaccacgcccagccgtataattcttatgaacagtagtttaagtattgtttctgtgaacatagtttgaactcagtaagtgactaaataaccaaattatatcatcatctagattaacactaccagtgatattagttactaacattctttgagtgcttgctgtatgcatggaacagttctcagttctttatttttttgtgtcattttataagaccattttaaaaagtaattaacccttttatactggtaagagaattaagcacaagagaggataagtgacttgtttgggctaacacaactggtagcagaggtgggatcaattaaacattatgtcctaaattcctgccagacatgtaggatcccagtggcaataataatatcagtagtaattaatactgattctattgtatgttgccttcctggaaaggacaatttccccttctgttcacaagcatagaaacacacatacagacataaacatactcacatgcacaattgatggcgtaagccaagctccatcacctttagaggttactttccttttatgaccaaagatggccagacatgagaagatagaaggaagagtccactagagtaagattctctttgcttcacaacgtccttgatggaagtctagacaggagataatgatttgaaccatctttcacatagatggtgctttttaatctgaaacacatgaggaaatttggggggctacatagctatccattacaggggagtcctgaggcagcagtaagatttcagactgaattggatccctacttggttatagttagagctccttgtccataacttggtcaataactgtacccagcttcatcacagcttgggaaatgtgaccatttaggagtgtgtccagttgtaaatgggaattctgttaatgtgagagagaaggagagaatggatgtttgaaaggaaattagcagtcatgggctcacctattgactacttctgtttattaaagatgaaagctttggcctaatttttctttattcacccttgcatactggtagttacaagcctgctggaaagtcattggcaaacttcactgatggttttaattaagtaagggtaagttttgttggtccaaaaataaaaagaccctctatttttaagttagaaatgtttatgtaaaagtgtcaaaagctctttaagcttcttctggcccattaatcttttttggccggggatcttgctggattaaaaaggtgagatcctggatttaagcaggttatggtggagtgagacccacaagtcaccttttatgatacacagaatttttagaagtacctcaaaaaaactcattatattttactagactgccagggacctcatttgtgccagaaaagtcatgagaaggggaaaaaaaagaaaaatcatgagaagggttgagttctttttataagtgatgggcagcagtccttaatgagaagatattttaattagctatacagttaaattaagtgtgctgaaaggataccctatcttatcgtaatgataaaaggcaattttcccacattccctagttttatatcaatttattagtgagttcagttttgtttcaaaatataagactataaaacaagtatataaaaatctttctccatattatttaaatatattttataagataataagacaaaaaccagtagctcataaaaagtaaaggatataagcagacaaatcataaaagaatgctgtatagatgtgatgataattccttcttattaataactagagacataagataaaacatgtgatatgctgttgtttcacaaattgttaaaagaaatttaaatatacatttctgcatttcagacaccctactggaaacacatgtttttgacaaaaagaattaagaaacatgatatgcagttttcttaggaaactccagcaaactaaattaacagcttttcagccaaagatcttagactaaggaaatgctatctttagttccaagcattctatggtcttgctaaactgtcttccacaggaaaatgggaaacaataatttaagatattttccagaattcatttgtagctttttttttttgttgttaaggacaggaactgtatctgcaccttcttgatgaatactaatttttcttaaaacctattgcgatgttattttgtgtgcctcatttcttttccctacttaaagatttttcttttccaattctattttttctcctaaagcctcttccacatgtaactcaacagctgctgcccgctttatcagctccattacctaagcaaaactttacatatccttaaaatctgacaaattcctagcatatatttttgtagtttctccaatgttttttaaaaacattcatagcttgcacatatggttatcatcaagagtgtctgaaatatgtcttcattataaagtttctttttttttcatttttctgtccatgttcaatctcaggtttttaagttatgcgtgtaaaatatgctctctatagaaattttcattgtgggaatcaagatttatataatatgttaggaaaagaattatggtaatttactcttttatcttgatgggatttatcactaaagcagctatttcagttactatttaaaatgagatagactttttaaaaactgttttaaattttactaaatagggaaccgggaaagaaggattcagttatttaaaaattattataatagtatataatctcttacaaattacacattgacttataaggctacttaacattgttgtctctctagtgttttctttagaaagctttttttctccttaagttgagatttcttaagccatttggtattatttttccattgtctttttatgtgttttttgcaccgactcattcctcccacataccagatctcacgcattttaacatgtccatcctggattattttgacaaccccctccccatttggtgaatgttgtatcaaggaggatgaatgaagagtaatcatctgttaggtggatttttaatagccgcccacactactatggtaacgtacatggacagatgtataatccagtcagcctgtttctgccttctttgttcttgttaggtcatatgttacctttttttgataggaattcttttgctatctcaagcccttcgtttcattgttttgcttatttgttgctaatattccttttcttgcaacattaaatcagcagcagcatctgtagcagggtccttcaatgcaggcaaggggcagtgcttggggaagaagatggctcttataaggaatgttaaaatggggagagcatctgaaatttcaggatgcttaaagattaaaaaaaaacaaaacaaaactgtgattgtgtggagggaggagggtaagaagctgccttgggacccattcgcttgctttaccaaggtgatgccttcttgctacccccacccgctggaggaaaggtagcaaggccagtgacctgctccagcctccctgttcaatggacttctatagacggatgatatttgccaggacttaatcgcatcagcaggatccttttaacaggatatccttagctaaaagaatgcttatagtaaatcaaccctgggtctatggatttaagaggtaggagaatgcccataaacagcaaaacactttgggggtataaaaagatgtttcataacttaaaaattctcttttatgtgaataataatctgcagaacctctcccgcacctcacctgttattcttggccaggaaaactgtgtttttaatgtggaaggaggggcttggggagtgtcatgggatctagacttggttacctgaaacgcttgactgctcctatccttgaaaatgttagtaaagcttgaaactatgtgagacctctgattgattgcatctgattctataattagaaagtgtgtgttagctcagattattatatttccccccataatgtatacactcttcaggccagcctcctgggttattttctctcacagggatgcccatggtgtgatacagaatgaaggaaataaaatataaatttagcactagtctcaagaactctgattcatatgatctacagttagcattttttaacaagttctcataacttccctctgaaacagtaggtacagaaaaaaaagaaaaaccaaaattctaaactactgaaaagcaaaacttcacattttgctaaaatatgggataattttgatttagctccaaagctgatggaattaagtagcttgtatacgttagatcctttaatccacatttgcccttggctaagagagtcaggggatgcactaaacagaaaggtagacttttgtatttgtatagcatggatggtattcttaaacccaagctctccgctgtatattgcaactcacagaaaacaaatagggaagaagtggcatgcgggaaagggagggacagatgtggtttctatcgggaaccctgggggcctgcatagcggggacctgtgaagactgttgttttgcatgtgtctactttatatggtgagactatcagagaacttggctgtggagataggagaataacacactttgatccaataaaaacaggctgagtgagagagaatggtgagcatgacacatcagccttcccttcagcattcaatctgagaagggagatggatggatgacccagtccccgtgtgcacgcaagtagcagaggatgacaaatgtaaggtccacatggctacattcacatttggagatgcacaaacaacaaagcaaaacaacaaaccaccaaataaccaaagcaactaccaaggacaacacaaaaagactaacatatcaccagacagcgttgtctggtttctcataccctttttttccccataccctgagtattgccagtgaggtggatgaaaaataatattgttgtactgatttgcatttatcaaattgtgcctagctccttatatttttgttgatcatttttattacttcatctgtgaaattgcctgtttgtcagtttttctacagggtgattggtctttttcttattgacttatagcactttgggaggccaaggagcagatcaccttgaggtcaggagttcgagaccagcttggccaagatgatgaaaccctatctccattaaaaaccctatctctatgtaaaaatacaaaaattagccgcatgtgctggtgggtgcctgtaatcccagatactcaggaggctgaggcaggagaattgcttgaacacgggaggcagaggttgcagtgagctgagatcacaccactgcactccagcctgggtgacagagcgagactccatgtcaaaaaaaaaaaaaaaatcctttttaattaaggaaggatagcctcctgtctggtatagatgttacaaatatttctccatagttgattatttgccttttggtttcagacaaatattttaaattgtaatatgattaaatttgtcagtattttcttttttaaataacatttgattttcataacttgcattataagctttctttactcaatactattgtggttttattttgtgtatttttctctgtctttgggaaagaaataacagtcaaaaaagctttagaaggccaatttggcaatatctttcaacatttaaaatcaatattaattaaaatttgtgtaaaaatatttattgagcatgtgcgctgtgccagtcacttttctaggttcttgattgttattgcttggggtgtgtcttgtgaaaggaaaataaaatgttggggccgcaaacactatggcaaagggaaacgttaagcttgaaaactgagccatacaaaaaactacctttccttttgttcttaaacagatagctgcaagatagaaggctacggatctccccaagtggccccccctcgctctgacaatgtaaactaactgcttatcttcactggcactagacaagacaaatgcatatttgacttctttctttaccttatgtttactttatcttatgtaaaatgcagatttgcaggcggacgcggtggctcacgcctgtaattccagcactttgggaggccaaggcgggcagatcacttgagatcaggagttccagagcagccaggccaacatgatgaaaccctgtctctactcaaaatacaaaaattaactggtcgtggtggcatgtgccggtagtcccagctactcaggaggcagaagcaggagaaatcacttgaacccgggaggcagaggttgcagtgagccgagatcacaccactgcactccagcctgggctatagagtgagactctgtctcaaaaacaaaacaaaacaaaacaaaatgctgatttgctgagcatgaaacaaatgcatgattgactgttcctttaccccgtctttccacatgcagcatgtggattcaggattaagtgaacactaatcaaagcctcacaaaaatgtgacaactcacctcactacatatccctaccccccccacacatttttttttccttttctctttcccctcctgcccactttttcctcccttaaatgtggaagccctaaaaaccctcttagggaaaatgtggggcacaaatcctatggtgacttgtgtctctgtggctttttcctaggcaggccttcaaccttggcaaaataatcctctaaattgattgagacctgtctcagacacttctttggtttacagtcacgtggaattgatgatgtcaatggtgagagggaagagtaaaatatgcttcataaacaagggttttttatattctgttaccaggtggtaggtatgatggagaaaggaagaagagcaggtgaaggaagttggttggagaattccatgctatccgggtgggtttacaatcctaaatatagtggtcagagtaggcctcattgagaaagtgacgttttggcaaaggcttgaaggagatgaagggatggggcagggcaagagcaccaagcaaatacaacagctcgtgcaagaatcttgaggcaggaacaggcctggtctgttctaggagaagcaaattcgctgatgtggccggattgaataggtggatgagtagtgggagatggggctgatgatgtaagggtatcaaatcactcagcactttgggctagtgcaaggattggactttcattctgaatgaaatgggaacctttgcagggttgtgagcaaaggcatgatcaatctgtttacatcttaaaggattaccagctactactttgggaaagggagcaagttactgaacagaagtacatgaccttatgtgtataacacagtgtctttacatagatgcattcttgttccatatataagtattaaaacacatgaatatatacgcatagacacaattcttggaagacatagtgggtgattctgtttgtttacaaatcatctttttatagatgtgaattttcctgtagtaaacacttgtcttgaaggttcagattgttattataaagcatatggtcaacttgaaatgacaccagaacaatgcataaaaagaaattcagcaatatattttgcacttatttgcaatgacatatgtctataatcttactcatgcagaagagttagtaaattttctacagaaaatgctaggagtttgtttccattagaaccagtttgccatatacgtatgtatatataaagtaaattttagggaaaaatgcaattaaaaaattatatggtactttagtaaggagagaaaagtgtgtttgctctcattttattgataatgaacatgataatgatacctaacatttatttatcacctacaaggtgacaggtattatgctcttgccttatttgcattacctcatttaactctcaccatcattctagggtgtaggtgcagtatccactatcattgtgaatatgaggagataaggctgagacagttgatgtgaatttccaggtagacaatatggtcttttgaaatcaaactggtactgacacctttattcttttttgttgttgttgtatttgagatggagtctcactctgtctcccaggctagagtgcaatggtgtgatcttggcttactgcaacctctgcctcccaagttcaagccattctcctgcctcagactcccaagtagctgggactacaggcatgcaccaccacatccagctaatttttgtatttttagtagagacagtgtttcaccacgttggcctggctggtctcgaactcctgacctcaggtgatccacctgcctcaacctcccaaagtgctgggattacaggtatgagccaccatgcccagcaagacctttatgcttgaaccatgagttgatactcagaagtggtatataaatcaaatcttactactttacataaaagagtatttctcatcttccttgtatattgaatacaaatatttaaacatgtttaaaaattggctttgaggaacttttttgtccttatcaaattaaaaactttacttattccccaaaatttcatataaagttaataaaaaataaactcaatttgtttacttgtttatttttatttctttttcctactcctggctgggagcatttccaaacttctctctcttttctgtattcctttgctgtgtgaacttccctgtttctgcatggtatcatctacttgtttagctttcaaaatctgtatagatatagccacagcttagcataaaacatcagtttgttgtgttaaaatgacctcaaattatgcctgtcctgaatagaattcatcatctttgtcactccgtttcctgcccttcttgatttgcttatttttgtcatttttttgacatctaaacttgaaaggggagaaaagtttactcactcttctttcatttcctgcaatcactcaccttcagatgtttggtctctcttacatattcccacttttgtcaccatcttcgtacatataatcctagtttgggttattacattatctgtaagaaccttctaattaatttccctgctgtcagaatatctcctgattttcaatacaaccagttcttaactgaacttatgttttcttaaagagtagttttcttgtgtcactcatcacttttcaccctaactactttattgttcctccgtcaatagagttaaaaatcactttatttgggatacatggcttattatgtcaatgatctatgccaatactcctattaaaccttttacacagagtgctaaaatggaagtttgagctgaaaagcaggggataatagctaacatattccaaggtgttactgggccttaagtagtattttcaaactaggggatgaaaaacctcttgccaatgtttaggacatgaaacgtattatatttttgagatggagagaggagttttgaggatttttttaagtgtatattttgtattatgagtctcattctcgtcaccccttcatctgcccccaaaactggtaataaaccttttgtccaagtcaaaagagaaggatcctaacgtcagctgaaaagcttaatatatgtccctatcatttggagggctggatagactggtgtctaagacacctgagaaatctaagtgatttctggcctaggcagcccaagatttgggaggttatttcaccaccctggtttatcggggcataggatgtgtaagcatttgcaatggactgtgtataagagtgagccagcaagggtcataatacatgttatttaaggctgtctgagggagaggttggcatgccaagacctcgggccaaaccccattgcctctttgtaaattttggagcacagccatgctcattcatttatggattgcatatggctgcttcgggctataggagtagagtagttgctacagagaccatctggccaataaagcctaaaatatttattatctggccttgtacagaaaaagttgttgaactccggtttagagaggtaggcagatttcagcagaaaaagtgtggaattattgtttgatttcttaggacagagaaaggagaaagcaaaatatctagaatagagaagcaatcatcctgattatgggaggtcatgtagaagggtgctaaagacagaaatttcagaagcctagttaatatgaaaagagcacacctgctttatatatattccatgtcctgtggttataacaccagctcatcatagtctcagtcaaacagtgcttgttgggcccctttcttcttcctttccattcaccagcccagtaaggctgagagagtgaattatgtacccgactaagaagaggagtaacagcaggaggggacgaagaagataagctgggagcacctgcacccctgcccagcttcaaagcaggttcaaagcttttattattacatgagtttcatcatttttattattaaaaggagatagtgttttgcaacttggagactttgaaatttatgtagcctaagaatagccagagaagacatatggtagaaacacattttttcaagggtcagggaaaccagtggtgtgctgtagcagaattccactggcttgagagagatggttgttaaatattcaggaacactgcgatcctgtgattagcacatctgtagcttgaaattggccaccatggacatatttatgccacagaaactgataaatgctgccaatcagaactgtttccccccagaaagtcagggtcagcttactagcacaccactggaccataacatgccccagggactactctgaaactgtagtgacagtggaaaataggtgggctttttattatactccatgagctcttcatgtttaatacaagggtagtacttggtttctctttttttaatttatattttgatgtcattctcactgtactgtaaatacacttatgattatttctcattaaatatgttgtttaacctgttttgttcaaagaaatgtttatctctctctgtttgccctatgcaaatcctaccaacttttgtgattcacaatggactgtacctttttcttgaatcttttccagattactgtagcttaaattgaattctcgttattgctcttcctttagtacttgtgtttcattgtgtaaaaccataagtaatatgccacatggtgttaaaatgtttttgtcctctgtgttttcacccttcacctatattgtatgctgatggaaggtaggaatcacggcttctttcattcttctatcatgtcagttccatgttcatagttaccattaaggaatttatttataaacaaatatattaataacagtttactcatgaataagtatggtaaacttactctatatttacactggcatttctctaccttcctagattatcgggatgattaaatctgatcatacatgtgaaattttgaaaagtatgactacttatccaaatgcgccagttggagaaaggatctgaaaacatttggactgtcttagcaaccgctgatatgtgtttgactaaagctaaatttgcctttttcagtcaaggcgcctcttttctctgttatcacataatcattgatgactactagctaattggtgatattttctgacctatctttcccgataataaaagaacttgtattaacagcattttttttctttcagttactatttctgagttatagtaagacctgattaagttggttatgagctagttgccccccccccgcccttttttttttgtctgcctctagtggcaaaatgcagtgatcaggataacacagggagcatcctcgttcaagagcgatgggaaaacagaaaatcattgtgtgcttttacggatagggtatataagagaacaaatcagtaaagctagctcactctcattttctagtaattattcttgcaaagacaaagcccaatacaatatgagaaaaacaatcttttcttatatggttcataacaaatttatttgaattgttttcacacagtctatttttagttgatgtgaaataaagcctcagtgatagttctacataaaaatagcttttaaatttttgttgaaatatccttcctttgttgagatcttcttctttatccttgtaggaatataaagattctatttgctggaaccagctaaggcaactttcctataaaggcccctttgatgatacaaacttcttcttcctcaaagtttatccctagatcaggtatcttttcttttaaactgtctttttttttaactttggaaaacttgaggattttcagtctatgtttgataatttttgtttatgtgttcaaattaaagccaggggaatgagtaacactagcctgtagagactggtaggatattggcagtcttctaatcaatttcactttgcagatgaggatatagaagacacagggatctgaagaatctaggcatgttcaaggtcagataagttagaaatagactgccccattcataggcatgacatcattagtatgttgggatttgtgtatgagtggtaatagggcatctgctgtggacaaattatttagaatctctagattgtttaaaatagattgcattttaaaaaattatcactagacaaatggagacttgacaggttttcataaattacatagtaataagtgatattatatataacatgataactatggccaaatagttattcgttaatatattcttttttctacatttactgtttttctctgctcacattcagtctttacattcacttattccctgcttcctgttaaccctaaaaatcctttactattcaacagtgtaggagacgaagaatatatttcccttacccatcgtaggtttatggctgaggcccctataacaaaagacagaataaggaggaaaaagcatacgaacttatttaatacaccttttatgtgacatgggagccttcataagtaaatgaagacccaaagaaatagataaacatgtttatcttttatgctaggtttgatgaagaagtaaatagtcataaagattggatataaagtgtgatctaatagtaataaaccagaagaaacatagcaagcctgttggttcagttttctttctttgcccctgtgccttcagataagaggatattcctttctcaccggagggttttatgacctgtttcaggacagaagggcaagagaaggtgagagtgactttcctgcttctgctgttttcgcaaatgccaaggtgtcatatttgggggtagcatgtcctcaactcctatccacagttttgatttttgatgcagaggctgggactgactgtgcatgaatattgaatagacttaggattcgtggaacatcagaggacacagatgtagatgcaagctcatttgaactatgtctagaaggtctgctacttcaaacagatgcggttttgagaccagcaatttaatgagagacaaggagagtctaggaataaagtggatttagttgggattgagattggaaaagagcacaattaaaactagaggactctcatgggaacaagtagtcctcttgggtgtatgcatgtgtacgtgaatctgattggaggtggaagaatggcatgtaggagagaaaaaccagtgttctgaggcagcaggtgttctgtaagacagaccaggaagaggtagtaaggcagccagaaagctaccatggtacaccagagaagccaaattattcttgaggtacccactgagcttgtcagctgcaatggctaagaggtaagttgtacttatgagttttaaggagaaatgctagctcttttaactggaatggccacaggtcatttgttcttgtggcagatggctggtctgctgtgactctgaaggtaattttacctattaacagaatctgaaagacaaaacttgctttcagtgatgtcataaatgctcttcactttcatctatttcagtggctgataatgttccttacttctgtagctgagatttcccaacttaatttgggttctcatcagggtagaattccatccaagtcaatcgcagcatctgcacccacagctctgagaagggaaagatgtgcttggtggtggccccaagtttgcagtatcggattggactcattagaattacaaggaaatgaaataaagaaaggtaaaactggatttcaaagagtctaagtgtggctgctgtcgtgcggaggtggtgacatgcagacatgcaagcttggaagctatgcaagaaacagagctgtgtgtctgaatatcaccatggttacggtctataaaaaataatgaggagagaaaaataagagcactggagtttgaaggcttgttttctaaaattggtttttatctatttgtctgataaaaatgaaaagatcctgtggtttgcattatcttgactaaatcaaaagccaaaaccaaattataaatttatccttaagtgctcactgctaaacattcaagaatgtttgtgctgtctttccctccccttgacatcatgaatcttaggtttaatgaatcattgtgagatatcaagtcatcctctaatctgatgctgagctacaatcaaaattcagtgatgactttctatctttcacccactacttcttaggcttgttgtcactgatgcagtgacatcgttcttgaatttcaatgcttcttgcatccagctgtggccattgattcactcattgaatttgatggtgttaagcacaataagaaagatgacttaatgggccttaaatgttcactcttattgaaaccattctgcaattttcattaccaagagaagtccctgctgcaatgttattctgttgacttcccaaatgcttctggtaagcaaagatacagggaaatgcggtccacaccagctgtttcaatctaattgagaaagaaactaagtgctgatatttagtaaaagtctacaaaaatgctctttttttcttaatgacgaaaggacaaaaggcattgcatcttcacaattaaaggaaagcatgaacatcggcggttttccaaaattagcattcttagacaatatgaagacccgtatttttagatgattccttaatattagaaaatatatactgaaagggatcagagtatgccaccccaaaatatagcactttggcataaggattattttgagccgaaggcaactgagaaacagtaaacattgaaaagacttctaccctcctgtatttggctaaaatcaggtcataaatttcccttcgtgaaggtgccccaccttctcccttctcttgtgccaggaaagggagaatggtttgtaatcaccagagatgatctccaggggtgtccaatcttttggcttccctgggccacagtggaagaagaagaattgtcttgggccacacataaaatacactaacattaacactaacaatagctgatgagaaaaaaaaaatcacaaaaaaacttagaaccttttaagaaagtttatgaatttgtgttgggctgcattcaaagccattctgggccacatgtagcccacaggcagtggattggacaagcttgacctaggctcagcccagagacagcaactgagaggaatctgaataacagaccttactaaacaacccttatctttcattagtttctcctacagatttaccttcccacaattaaccacccttaaaagcctaatcctgttttccttcatcttgtcacttccacagtttgttgctctatgttaaaatgctgtgtatccctgggtttaactgcttttttgggtctttgctttttttctatgaaggacttcatatgcatatgtgataaatgatttttcctgttaatctcccttttgtaggtttaacttgcagggcaccagccactgaacttacgagggtagaggaaaaaatttccctttcttacaatatccgtctggtttaaggtgaactaagaaatggcaaattttaaaattgatgtaccttctgaagatgctgaaaataacttctttggttacttttgatgtatcttacatgagtaattcaggaaatatttaataacaaccagcactaagcccaagattagacaaaagcactcaggaattatgcaattagttatttattttttccataaattgtaggagctttgtggtcaggagaggccattatctttttcaagatactataccttcacgttcagatataataaaccaaaaaatctccaaacgttcatcctttcagggttaccagtgttgagtgccaagtggtggtagtctacttttgactgttctggaggtcttatttttttagaaaaatctcaaaaaatagaatgtttactttaaatgtgtgcattttatatgtgtttatgaacatgtatgtgtgtgtatatatatgtgtgtgtatatgtatacatatgtatgtagacacatgtgtacatgtatctgtaaaatatcactcaaagtcaaatatcttttatgttagctcaagtctaagaatgcttgacactttactgaaagcagatattttaaatgaaatttgacttttgtcttctttataatttctaataatatcggttgcctgtcataaactgaaaaacacatttgctatcttaggcagaataataaatatgggttgtaaatagtgtctttcatggataattaaactttttttattaagaatgataatagagtttactgtaaatgtggctatcttcccattacttatatttttgaatgtcattggaaacattgaaaaaaatagtgtgctactccctaactttacttcttttactccatccacatagaatatagtagaaatctctttcaagttttgttttctattattttgagaaaaatattctcttcacatgtatttccccagaaggacattctctgacataactatagtacaatgatcccattttggcgtgtgatattgatactatatatcacgttatccatggtccatattcgctttggctggctgtcccaattttttccttggttcctcactcactccaggaccctccactggacttgttatcatggttctctagattacttcaatctgaaagagtttctcaaccattgtttttaatcttgagatttaaaaaaattataggacacttattttatggaatgtccctcagtgtgggtttgtttgctgattcctcaagattaaattccagttttgctttttctgcaggaataccacaggaacacatggtgctattcccagtgcatcacatcaggaggcacgttgttgtttgtcctaaaattgcaggtgttaatgttgattggttgattaaagcttctccagtgtgaagttattccttttcccctttgtaattagtaagtagtttgtggggagatactttgagatgatatataaatttttttctcatcaaatattcacctaattagctttagcttcaagtaattcaatgatattttcttacttcatcattccctctatatttactagtatacattcccctttaagggagactttttctatttatttatctattaatttactcattgattctttttttttcaatgaattacaatctattagagttatttattttgatagtcaaatgacatgagtttggccaatgagagcctcctgtgtcttttggataggattccatcattattcgaaaacttttgtcactctctgttgcaacaagagattccagcttatcattatttcccttcatcaaccccagaatcagtcatttctctaaggagccgtggtttcttttagtgaagattaatattcagaaaccaagatctgggttatagatgtacttactgttattagcgtgttgttgcttctcagctctctctagaaaacatatgtacatatttagatatctttatttctatatttatttatcatagattagctgttattctagagctttataaaaatggaatcataacggaagctgtgtcgttcatctggggtaatagctgagtttcgttttcccattgccacggaaaactagggcgcagacacaccagcgtgacgttaagagcagaagtttaataggtgaaagaaagagaagagctctctctgctgcagagagaggggtcccggagaaaaatgggttgctggttccttctcgaaatgcacggggttttatagatgagcttgaggaggcggtgtctgatttacatagggcaaacaagattggtcggaccaggtgcgccatttgtatagcgaggaagaatctggccaccccacccaaatcttttattttgcagatggttctctacctgtccgatgccatgttgcctattccttactgtacatatggtgacaaagaaaggaaagatggagcctgcatgttgaacatgtctggcccccaggtagccttttcctattggcacagctgctgacattcatccatgcaagcttctaacttgcttatttatgtctgcagcttaatttttcaggctgctcttttttaggaaataaatgatttggaggctgctttttattaaaagggaaaccttaccaatgaatctcttaccatcactaactacctaaataatttctttttagctcccatatcataaccatgtattctttttgttcagcttttttcattcagcataatggttatgaaaggcatccaggttgttccccatatcagtaatttgttcttttttattccagagtagcatcttgtatgagaatacttcaaatttttatccatccttttgctgatggacttttggattgtttctagttttagactactacaaaaaaaggtgctacacacattcttgtccacatctttttgttgccatttattttcatttctattggataaaaatctaaaagtggagttattgggttgaggaatattttaccctttaatttaactttttaagaaaattataggctgggcatggtggctcacacctgtaatctcagcactttcagaggctgaggtgggtggatcactttaggtcaggggttcaagactagcctggccaacatggtgaaagctcatctctactaaaaaatacaaaaattagctgggcgtggtggctggtgcctgtaatcccagctacttgggaggctgagataggagaattgcttgaactgaggaggcggaggttgcattacaccactgcactccagcctgggagacagagtgagactttgtccaaaaaaaaaaaaaaggaaaaaaaaaaaagaaaaagaaaaaaagaaaattataaagctttttctaaaatagttataaatttacactcccaccaaaaaatatatgagagttctgataattctgtatcctagctaacctttggtgtttaattctttttaatggtagctactctaatgttataatcctatctcattttatttttaatttttctatttttaatatttgtgagtacatagtaggtgtatgtatttatggggtacatgaaatattttgatacaggcatgcaatataaaataagcacatcatggagaatgaggtattcatcctctcgagcatttatcctttgagttacaaacaactcaattacattcttaagttattttaaaatatgcaattaaattactattgactatagttactctgtggttctatcaaatactatgtctttttcattctttctaattttttttgtacctgttaaccacccccacctctgctgcccccaacttcgccctcagccccccactatccttcccagcctctggtaaccattctccactctctatgtccatgagttcaattgttttgatttttagatcccacagataggtaaggacatatgatatttgtatttctgtgcctggcttatttcacttaacatagtaatctccagctctatccatgctgttgcaaatgactggatctcattcttttttatggctgaatagtactccattgtgtatctgtaccacattttctttatccattcatctgttgatggacatgtaggttgcttccaaatcttagctattgtaaacagtgcttcaacaaacataggagtgcagctatctctttgatatactgatttcctttatttggggtatctaccaagcagtgggattgttggatcatatggcagctctatttttaggtttctgaggaagctcttaatggttttctatagtggttgtactagtgtatattcccaccaacagtgtacaagggctcccttttctccacatccttgccagcatttgttattgcctatcttttggataaaagccattttaactggggtgagatgatatctcattgcagttttgatttgcatttctctgatgatcaatgatgttgagcactttttcatatgcttttttttttgccatttgtatgtcttcttttgagatgggtttgttcatattttttgcccattttttgaccggattattagattttctcctatagagcttcttatatattctggctttttcctttcctttcctttcctttcttttcctttcctttcttttcctttcctttcctttcctttcctttcctttcctttcctttccttcttttcttttcttctctctttttttttttttaagacagagtcttgctcttgtcacccagactggagtgcagtggtgcgatcttggctcactgcaacctccgcctcttgggttcaagagattcttctgcctcagcttcccaagtagctgggattacaggtgcccaccaccacgcctgactaacttttttgtatttttagtagagacagggtttcaccaggctgatcttgaactcctgatctcaggtgatccgcctgcctcggcctcccaacgtgctgggattacaggtgtgagtcactgtgcctggccatattctggttattaatcctgtgtcagatgggtagtttgcaaatatcttctcccattctttgggttttctcttcactttgttgattagatcctttgctgtgcagaagctttttaacttgatgtgatctcatttgtccatttttgctttggttgcctgtgcttgtgaggtattgctcaagaaattttgctgagatcaatgtcctgtagattttccccatttttttttgtggtagattcattgtcggaggttttagatttatgtctttaatctattttgatttgatttttgtatatggcgagagataggggtgtagtttcattcttctgcatacgcatatccaattttgccagcttcatttattaaagagactctcttccccaagtgtatgttcttggcacctttgtttaaaatgagctcactatagatgtatggatttatttctgtgttctttactctgttccattggtctgtgtgtttgtttttatgccagtatcatgctgttttggttatcataatctgtagtataatttgaagttagctaatgttattcctccactgtcttatttttaaatggttttatttgtatttccctacttactaatgatgcttagcatttatcatgtatttattgtctatttatatatctttctttgtgaagtgcctcttcaaaggcttttttcatttaaaaaattgttttgtactatttaattgtagaactattttatattgtctttatgcaagttctttatctctgccttaatgggactaggagaatactacaggaaaagcaaataaatacaaaattacataatacagttttaagttgtttagtagaaacatgaattctgtgcaatagaggggagaggaagaagcaaataattcgtctgtgggtgtggaagaatatgtggcatctaaacatggactgaaaactgactaaggttttgcttaacaaaagaagcaatacagtatgtaaggaaggaaaggtgtgaaacagcatagaaagtcagttccatgagcatggaaacttgtctgtttattcattatttagactctagtactgagaacggtacctggcaaactcttaggtgttgaacaaatggtgttgaagaatgagtaatcgaatccttgtgacctataggttcatggacagcatcagcaatgttactagagagaaatgacatgatcttatttatttattttgaagcataactttgatggctatttgtataattaatgtcagaagggagagaatagaagtcagtttggaatattttggtagtatttagtctttcatttagcacatattttttgagggccattgttggtagttttaccaaggaagaataaggtgtgaatcctgctcccaaggggttctcagaatgtttgagaggtagaaatggaaacagacagtcacatcacagtgcaagcattacaatggagaacgtattccccgagggcctgtgtttgcaaggtcattcttgggcattagaatctcttactggagctgaatctacatgggtatcaaccagaagagggaaatcagacaaatgtttccataaaagatgtaccataaacaaaccctctgagacccagtgaatatagtaagtaagaagcagcttggaattcacagaggttcaaggtcaaaaacagaagtaggtcagaggtagttgggtgtcaggtcttggggaacttgtaattatatatggaaatgtttgagttttatccattcagtgatgaaccactgaagtgatataggcagaggaatgacataatcaaatttacattttacatagatcattttaaaatttatgtgatagatgaaagaagacaggattggtatggagaaatcagttgcactggtttaaggggtaaatgattaaggcagctagaaggtttctctcagagtgatagcttttatttatcaaaattagcttataataccaaactaccatggtataattctgatttaaggtattgttatcttgcctgtctctcattatttacaatttgaaattgagaagagaggcttagtgttgtcttacttgccaactttagtaaaatataacaggtatcattaatgttgccaagagaagagggattctaatttaagtaaagtcaatttttagaatcactagcttgtacagaggacctgattcttcagttctgaaatctaggctgattttattctttaaccaaagtagctcaattgacccaattaacaatgcatttctagacacattttaaaatttctgggagagattttagaataaaaaggagtgtagagtctagtactaaactcttctttcttaagttctcaagtgcatgcctccctaatcttaaatatcttatattccaaagaatgggtctctaacgtttttacagtttaagcaagaaataaactcactaaaggaatccaggggtagtagaaacattgtgcaataaatgagtagaatcctgtcctatgttgtattgagaattcttaaatatgctggtctctggactgcatgaaggaaggtccattcctcacctctccccttctcaatatacaagagacctgacctctgcagaccgcatttcacaggctttcctgtcagctggcttcctttcagctggattattccatcaatgggaggcactggagtgagattggagagtgggaagtaaggagaagccagggtatttattatccttgttctctgacttcagtggcacctctcaaatgcagctcctctgaggctctagcttccaatgtaagcccatcctggtttcagccacttgcactgaccctggacaccacaagcatcacctcctccctccagcccaggctggacaccagcttcctacatttcctaatcccgaggatgtctccctgtcttctatgtggcttcttggctcttctgtcccctattcatcttattccctgtattaacttttttgatttaaatgcttagaatgctttttgttttctatgttgggccctgactgattcatgaggcaaacgagatctttaagtgcttgagttaatcatcttgaattaaacattttcagtgaatataataattttccctgatacactattcaaatgaaagatgccacctcaaagaagaggatttctgggtgatttgaaacaaacaaatgaaccaaaagtcctgtcaaacatcaatgtcttttcattgactaacacagaatatggccttgaataacaaatgtgatggcaagttgctttactaagatattattttatgtatttctccccagattctaccctgtctcctgcccccaccccaagaagatagacagggcctgtggtgcctatctaatggggagatttttgcaaggcagaaaacagaagcagaagacagaaacagaagcagaaaacagaaacagaagccttttggagttaaaggctttttgaattttcttaaactctttaaagaaatagtgttgggtccataactggggtagagtgaagacagaatttgaagtaataaggcttttgaagagtcagatcaaggcttaaggcttcaaagggggcagacatgtctggatctcaggaatagctgaactcacatcagaatcccaggcacctccccgagcaggttgaatgatctgaggataattttctggtgcatttagggaggcaggatgctaggtacctgtgaccctaaaaagtttgtcatagagaccccagaactttgtggcctgaggaactatatggattgggctaagtgtctgtggtcaccaaagcagaacgatgtgggatcttaccatctaccttgagtcccccaaaaccccctgagacttcatcatcctgaaatgtaaagcttccccaaaagataaaagtctaatttcctgccactcttccaggatggaaactagtgagtttactgactcatatttataaatcctttgcaaaagtaataatatgtggttcacgcttttttatttacaaagctactacaaattatattttaacaaccagatgttaacagcaactttgcttagtaaaggtcataggaaaaggccacagatggagagattcaggattaataaaagccaatgtaatagaaaacataataaaataaaaaacaaagtagatcaaatatttcagggtttatgccaaggtatgattatgaagagttactaaaaaagctgttaggaaatattttaacttgaggtaattacaaaaaatgcactattatacccatacatcatatacagtatacttaatacagaatttggaaaatattgcaaaccaaataaatattccattttcaacaatttctatgttattaagtacttgtgacattgattaattgtatcttctacagttgagactttaccaatatcctactgttactatattaataggttgatttggaattttaacttgttcataacatgtcatctgtttaaatttattagtaactatatatctcttggtgatatacatacctgtagatattatttttcctcatctgtgttttcaaaattttctgcaaagaacatgtaacacttttgaaatgttagttaccttccaagttcttagttttttccaattggcaataagaaaagttaacttattcaccattttttttgaaaagataggatgcattgtttatatcagtattactttaattgaaattaacctaaatttattctgagaaaaatataaataggattttgaatcacgtattctttatagcaaccaaatggagtcatttagtttattccagcccttatagaagcttaccaaacagagcaaaatggatcacatatttaaaagcaagttggctacactggtggcatctcaagtcattcactggcatactgaatcacaagatgatttcattctaaagatcaaagaagattttgttttgcctttaagtatttgagtttgctttaaagttcactgattcatggtttctcactctatcgcattctgggtcccctgaaacacaaagtaacacagtaaaaaaagggatggtaagacaccagttgtaacatgtcttatcaatgctgtatactgatttgggaagcagtgtgttacagtaatagtgttttgacttttagaaacagagaatgggtttaaaacttggacctgccacttagtagatgcatgatgtgatacttaatctctttttgaacttcgaagacccttatataagaaaatggggtcatgtattctttgtataatattttgtgtatgagttttcctcctaaatgatactagagtgtgtttgaaattaattagccaaaatgatttagccactccccttttgacagatttttgaggggtttctgtggttttactattaaaaatatatactactaacattaaaatccttgtattcttgttgtttgtgcaggttactctggattaggaatgatgaaaggtagaagggtagaaaatgtagtctcattattaactggaagacattattaaccatggaacacactctttttgcatgcataaaaatctctttcttttcatgaaaagcaattgtgggcagaatggagcagctatttcctcagaggggagtcactctatcagacagagttagtcttttatattttgtgactctgtctttcgagctaaggcagagcaattgttctttagcaccccttcctcgctttttcgctatatacagaagtatcttcctatagattagatatagatgatttcccacttggacttagtagttgctgagaacacttaatttggtctatcacttttccttttttttctgagcaaaagtatcttcaaagaactaaaaaaaaatgtaattctaacatgaggacggtctgctatcttatcttctgttttccaattatatctgccatctcagttttaagatcaacaaagaaggtggataaagcacttgtgaaattatcagccacactgagacaacagtattctcagaagtaggagttaaggggtctctgaaataagagattaatttatttttaatctctgtcttttttaaggattggatttttgaccaatccatttcaacaggaatgatctcagagatagaatgtgaggtgtgcagctctctcaaatgttgatcattatattttatatcattttgttaattaatttatatcgctttttcttaccgagttttagcaccttcatgtcctacaaagagatgagttgatagatatcaggttatcttagactacacattcctagaataaacttatattcttcagtgaacttctgtttttacttaggaaggttaggaaacgtaactagattatgcaaatctgatctgaacaaagatttgaagatataaaacgaatgaggttagttatcatccccacctgtcttataagacattaagaaggaatattatctattcagggggtagtttaagaaaaactggccgaggaaagaaaggaggaccccatgaaggtgctggaggatcaggaggaagaatagaacaagaggaaaaaggcagtcagcttaagggaggccaggagggaggctgatcagagtaaggtcaggagaaagggagaagtgtttaacttaggattttaggtactccatgcttttattaccttttctaaggagttcttaagggaatcagttttagaaatttcttaagttgtagaggctacttcaaaaaataaaaaacgctgatcattgaatagttgaaattttgaaacttctcctttcctacggcatatcacaaaggattattttcttcatattccaagtttttctagtattatcaataaagttcaaagttgttcttaataaaagcctgccacagtttaagaagctggatagcagcccacaagtacattgattcaaaataagagaacctgagcatcaggctcgtaggtttaccatcactgtctccaatgcctgtcttatccatgggggagacccattaagtagcgaaacagtgcaaatgaaaaagcttacaccaaggacaattaagatggaagaataaaagcttagatagtgctttcaagcaaagggagcagaacagtggtcaggagcaggaccagcccaactgtctagtcactgggactccaaagagaggagacatcaacagagtgtctggcatgatgaaatgccaagcacccaaaaacacagtcctgatctgagtcttgacattgaaaccctggaagaaaatcagtcagaacaatataggtaaaaatctggaagacggagcttttattgagtttagcaagaggaagtagttgaagttcacctagttttgggaatagttgctcaaagatgattcttgtatattcactgccattgtttgaggaatttggattatgtcaacagggtgagaaggggcaattgggtgaaggtcatgtgccagaggggatgggaggaagagacagctgtagggatcaagcaaatgaaagagccgtagtggaaaatttagtccttcactctctcttacaaagtggatgaaaatatttattgaataaaggaatgaaagaatgaacaataagtataagaagtaaaaatagagtgcaacaggatttcacagtagtgaccattactccagttggggctgcttacgaattcatgaaatagttgacacatgaattacaagttgaaggatagacagtattggacatttgagagagaagaaagcacaaataatgaccaagaagtgagaaaaagtagggaagggatagggaacaataagtagcagattgtttttctagatgtattttttaaggttaatgaagtaagttcgaatgaaataagagggtatcttgagtccctatttaaggattttaattatgtaaataataaatgactgtgatattatctctcaattaggtaggattcatatgagcaagatgccatttggttaattttgttcttgagaatgtaaattgtagttcgctttagttaccaaaaggtggcaaagttacatgcttgatagtagttttaaagtactagactgcttcccaaacaagccctctgatttttattgagtctgtgtcaacacacatacaacatgcaagataacaacgggcaaaagccacattgaagtttgctgtactgcttgttgatctctgttcctggcaatcctgcagcatcacagcttgcaatattatgaatcatagccttgccttttcattttattctttatttagtactataattatctaaatgagctttgaaattatgagttgaagcttcagactagtctctgattctgctattccaagtataaatttggttcaatactttacatgtcttaaaagagcaatgcagtttttaagaggcagttcaaattctcaccaccttcttttctctcttacagcttctcaaggaataactactgtcctgaaattagaatgacttttttctgtatgtttctgttttaattacttattctggttaatgcctcctaacaaagatcatcaggaaatctgtatttgaataagttcggtacatttcgatgatggagaatgcacatcataagaaagcgtggagcacctcagtaagagggtgttagaaaggatttattacagatttggacttgcattaggtaagtctgggaggactcaaggaagtgggactttgctccaaaatgtttactgttaggaagcagaagtaattctattattgaatgtcttatcaaatcttacctaaaagaagggaagaataggataaaactaaagctgtaaccggtagagaagcaacaatcactcctattagctgggaagaggaaatgacattcagtagagagaagaaagcataaatagaggagatttggtcatacttgtggtttggataatattcctggtttgccttcgtttaatatgaattcagacttgtttttattttggcctataatgatcacaaggtggctttgtctgatgttgatgtaaaattacttatgttaagtagaagaatattaagcctatgtcatcagtctcataaaggtgagttccaggccagaccctagttgttagtgttagctttgctcacacatgtcaagggctgctttttgcatatatttatatatctacatctagttgcatatactctatatcatttgggctatgtatcattttttgtgtttaaatgtatataaatgttatcatactgcatgcgtgatctctaataatttgattcttaaaatgttcattcttagaggggtgtgatggctcatgcctgtaatcccagcactttgggagaccaaagtggaaggatcacttgaggtcaggggtttgagaccagtctgggcaacacagcaagaccccatctctacaatataaaaataaagattagctgggtttgattgcatgcaattgtagtcctagctacttgggaggatcacttaagcccagcagttagaggctgcggtgggccatgattgcaccactgcactccagcctgggcaacagagcaagactctgtctcaataaaataataaaataaaataataaaataaaataaaataaaaacatagcataacataaaataaaataaaataaaataaaataaaataaaataaaattgctctaaacatattcagtttgcttctttttgactgtgtgtatggttttccattatacaaaaagcctcctaaatatacgtggacattcaatttcattatgctgttttgctattataggtagtgctgtcaagaactataactatgaatatatttttcgtacatacatatggagttctttagggtgtttattctaaaatgaaattaccagattctataggatggacatttcaactttactaaatattgtcaagttggtctccaaaaattgattgtataagtttttactttgtcctgcattgttgcagagtttgttttcctgtatctttcaacagtacttgttatcaaattttctcagtcttctgggtatgcagtagagtctcattgttattttcatgtgcttttatctaattattagtgagcctgcctattttgttatataacttttggccatttggtatttccaatttcgtgcatggcttgtttatattatttggttatttttccattgaatgtaggtgttttgcttgttgatttgtagtgtgttttcacatgttttgggttcctattaattgtatagtcagtgacttatcttttccttttttcatggcctcttcttttcttttctttgctcgtttttctttctttctttcttttttgttttgttttgttttgtttgagacggagtctcgctctgtcacccaggctggagtgcagtggcgcgatctcggctcactgcaagctccgcctcccgggttcacgccattctcctgcctcagcctcccgagtagctgggactacaggcgtccgccaccacgcccagctaagtttttgtatttttagtagagacggggtttcaccgggttagccaatggcctcaatctcctgacgttgtgatccacccgcctcggcctcccaaagtgctgggattacaggcgcgagccactgcgcctggcctctttttttttttttggagacagggttttgctctgtcactcaggctggagtgcagtggtgtaaacactgcagttgtgacctactgaactcaagtcatcctcctgccgtagcctccagagtatgtgggactactggcacacaccatcatgcctggctaattttaaaatttttttgtagtggcagggtctcaccatattgctcagtctagttttatggcattttctaacccagaatttttaaacttgcatgtgatcaaatttatcagtcttaaaaaaattgtttgtattatttgtcgcttaaaaatactattctattctaatgacaaaattattctctttttgttctaaaagttataaagttttatttttcacatcagatctttagttcatctaattttgtgtatgtgtttgtgtatgtgtgcataatttgaataggaatttatttttccattttaaccatatagtttgtcagttgtccaacacttttttcccatctgatttataatgttacctaattcctaagtgtagttcttataactacagggatctatttctaggctctatatttaattacattcttcaatttgcctagcactatggcagtatcataatattcaattgtactttttccttctgtttcttggtcaaagctgacttagctttttgtagatctttatgttaccgtattactttatgttgactatattatccttggaatccttggaatccttttgggaattcagtaagtgttgcatttagtttatacaattatagggaaaatatctacctttaagcattgaaattttttattagtgaacatggtctgttatcttcttttatttaagacatttctgttcttcaatgatttaaaaattttctcagtaaagtcttacagattgttttagacttagatcaaagcacagttattaaatatgttacatattatctttattttcatatattgatcttatattcagcaaccttgcagaagtctcacatttgctaatgtataatgtgtgttctttcggatttgctataatagattaactgtctttgtgagtgatgacagctttgttcttttctagttcttgtatatttaatttctgttttgatttacagaagcaaacactctagcttattcctgaattaaaaggaaatgcttcttatgatttactctgtagtatgctgtttcttataaaataaataatcattaagagattaggacaattttaatcgatttctggtatgcttaaagcctttattcttcataaaagcgtactgaatttatcaatttattttattgcacaaataccttgttcaataaatttttgtcttaaatctgtatgatgtattaaaataagattttctaattttaagctatctttgtactcagatgttaaaccatccttgaattgtgattggttattatgtattacttttccattttaaattagattttaaaattttagtttgtaaataaaatcaacctcaaatttttctttttgatgatgtccttacctgtctttggtattaagatttatgtagtaatatagcattaagttgcaaaatgtgctccttctattctgcaacaacttgtacaaaatagaaattatctctccttaaagctttaatggggcccttatttaataatatctgggcctggctattgatcagtgggcaaatttttaactattgattattgaaattattattatgcagttcaggcttgctatttcattttgaaacacttaaaatatgaatttcatcaacattttcaacaaacttaagaaattatttttagtgttttttattttttttcaaaatttttatcatggttatatttttattgtgtctaatactttacctttcctcctttgttcttgataacacttgcagtggtttgtcaaacgtattagcatctagaacactaggtttgaaaatgttctttctcgtattcttgattttttaaattctattaattactcttttcatctttattgcttcttgtgatcagtgtttttccttgtattttgttcttttaagagaataagtgaatttgtttgaatgtttttctttctaaaatatgtatataaggctctaaattttccagtactgtttaatctgcattcctgtacattttgatggataatttttttcactgaagttcagttgtattttgtcaagtttattattaatttttctttaacccacacgtgatttagaagtttttaacttaaattgtgtttaatgaccttttcatcattctttccttatttacctgcattttgatcatgtgacattatgaacattatataaattttttggcagctgttgtgacttagtttatggcttgataattgattggtgtttataaaagttttatgtatactgtatttgataaaccatgtatttactttaattattgggtaccaggtttcatatatgtccattggataaactttttgtcttgtttttgtattctataacaatgacttttgtgtggaaatattttgttgtgatattaatttttgattagtgatattaaattagctatcaacttttccttgattagtatttacctggcatatatacttttccatttatttagtttcatttcttttaatttattttttcatttttttggtttccacacttgtatcttataagttgacatagacagatttccaaaattcaattagaagcaagtttaatcttataacacttatttagatttctgagaatttggctttatttctgttgtcttattggtgtgtgtttgtgtgtgtgtgtgtgtgtgtgtgtgtgtgtgtgtttactgagttttacctttaccattttcctctttttttttctctgttgtatttcgttgatcaaatgtttttaactctctttttgtctttttattatatgaagttcttatacctttacatttttaacatgcacaaatgatgtgacgcagtcttaatttaatcaatatctccatttgattctggaccgtagaaggaccttttggttcagtgacttcatcatacttgtgtagttatttcagtaaggttctgtgagttaggaactccttcagggttggttagtctataaatgtttcacactctttcttgaaaggcaatttagcctgctttaaggttctagcttgacagttattttctcccaacattttacagacattatgtcactttctgttggattacattgctgctttgtaagtcttctttcagtctaattataatgctcttatggatactgtgaattttttctttagttgcttttaaggtcgttttgatatctagtaatttcctataacgagtacagttgtagaaacccttttattcaccctgttactggtagactgttcttcctgcatctgagacagtgtgttttattagacaggtgaaagtctaagcttttattccttttgatattgccttcactcagcctctacattttctcattttggaacttctgctagctatatatagaatctctttattctgacctccatgtctcttaatgctgttttttattttacgttttatcttttcatgctgtattctgagtgatttcctcagatctttcaactcccttaaatttcttatgtggtctgtgtaaattgctgtttcatagatttattaagactgttaaaaaacagtaaaactcaaaacatacatatctaaaatgtgcaaatcctaagtgtaataattacagaccaattagttttcaccatttgaacacatccatgtaaccaccaccccgattaagactagaattttataagcaactgctacaatgaacatggtgatgcaaatgtcttttagagattcagctttcaattattttggatatataccaaggagtgggattactagattaagtaattcttttcttttttgagacagagtgttcctctgtcacctaggctggagttcaatggttcaatcatgcatcattgcagccttgccctctcaggctcaagccatctgcccacctcagcctcccaagtaactgagactacaggtgtgctccaccacacctggataatttttaaaatattttgtagaaatggggtctcactatgttatccaagttggtctccaattcctgggctcaagagatcatccagcaagaggtgtccctcatagacatcccagcccatcctccttaatttaaacactatctattcctatctgcatcaattacttttgtctgtttttgaaccttttataaatgtaaagtgtgtactcgctgtgtctggtttccatcacttaacataatccttgtgagactcatccattttgttacaggtagttctggttcagtaatgatcatcattttgtagtatttcactccatggttataccacaatttatttttcattctctcattaatggctgtgttgtgttcaggttttgaatactataaagagtgctactttgaacacttttgatgcacatacatatgtacattctgaaagatatcttcctatagagcggaattgctaatcataagatttgcatgagagttccagttgctctatattctcaccagcacttagtattggctatctctgccatgttaccattttgtctcaaagaacttccaaatttgcaaagaaatttgaaaacagtagatttttaaaaacatttttaatatgtcaaagaaatatttcatttagagataaaaataattggcctggcacggtggctaacccctgtaatcccagcactttgggaagcctaggcaggcagatcacctgaggtcaggagttcgagaccaacctgaccaacatggtgaaaccctgtctctactaaaaatacaaaaaaaattagccgggctcttggtgggcactggtagtcccagctactcgagaggctgaggcacgagaattgcttgaacccaggaggtggagcttgcagtgagctgagattgcaccaatgcactccaacctgggcaacagagcgagactccatatcaataataattataattataattttggtcacaataaatgatgctttacaaatatgagttcaaatgttggatttattggaattttaaaataagagtggtctttgccttatttctttgttctattgtatgaaacagtctgacactatttgtacttagtttcctaaaggaaattgtatgaaagaaccatgaatatagttgctaaaactgttcagaatatatgtgtaaatgatgtgaatcatcactagtatgtgaaaatgttgaaagaaaaagaagacaatgaatctaacgatcttgcgttctttgtcaatgcttgttggttgagtcatagaagagttttacaaagatttatagttctattaacccaaattgaagaattttaaaacaaaagtaatgcttgacaaatattcaataaccagggacaaaaatagccctgtgacgtatgttttatcagcaaagtcacgctgctctacacatgaatttaaagctccaaggaaaaggaaaagcttatttttgaggtagccaggcagttatgagatttggctttgaaattgaaacttttcataatacaaatcagtaagatcaattttatacattttcaaatatgaatcaatgtataggacattataattgtaatcaactgtattatgcaaattggttgtaaaaactagaagaaaattttcaataacatttctgaattggtaaatttagaattgttttcagtttgtgtaataccttagtgaatttaatgtcaatattgagttaacacaaaagtgaatttgcttatctgagacagatgtacttttgagacacagttttgaaactgacacgttcttgcttaaaaaccaaatctattgttctaaaaaaaagatgaacagagttgtcaatattgcggatattaaaggaagatgatttttgatattcaattcagttattaggaaactttcaagtaagtctgtaataacttgggaagatgcatctattttcttactgtaaattatatgtagtataaatacagatcaagtacttctgatgaaaatttagcatccaaaaggagatgtgctataagtataaaatgcttactggattttgaagactcagggaaaaagttatgtgaactactatcttcttaattttttatattgattggatattgcaagataatatttggttttgaatatttggttaaagtatattattaaaataaatttcttctgtttttgtaatgtggttactagaaaatttaaaattacatatatggctcacattatatttctattgtacagtgatagtctagagcagtagcttacatgtgcatattttcagaagaagcaatctcaaaccagtatgttacaaagcaaattgggttaattacctgtgtttcaatctagtagtttcccattagcttacttccatcaagaagtaagataaattccttagggtactgcagactctgtggtcaaatatttggctcttatttcagccatgtgagctactcttctctccattgtactttagtgtgtctaaagaaatgaattcttttttctatttttgatgatgccattcaatttcatgagttttaaaaatttacatcaattattcctgctacttagaatgcctttatcatcttgactgcttggtgaatttctatcagtttttccaagaccttattcttatttgttcctgttcaataattttcttgagttttctcactggaagattaatcactgcttacctcatctgtattaccactgtgttttccacacaccccttatcaccttttatcaaaatatttttgtttgaaagatttattttcttaccacctgtaaattctttttggtcttgttccctacagttttttacatgtctggcatagcacctggtttatactatatatatatgaatattttttaaatgtatgaaagacaaaaactaaagtaaggtaaaacatctgacttgaaaaataggataaaataaataaagggaaagttaaacatttaaacatttcttaaaaatggtagtccaggtccatatagaaattttcttagctgtaatggaagaataaattatttgtgaaaaatctgaaatagtacaaaaaagatgatttccatttttatttagtaggaaataaggtattataatttaatatattattattgaagacttattccttactgacagttttcttaatcatccaacagcataaaataattttattgctcacttgtgcattaaattactagctctgtcagctaccattaaatattttaataagtacatattagagcttacagaaaatattgaagaaaatttatgtgactaaaaatagtaattgatatttttagaggcacgctacctcaggcacaatggaaaacaattatgtctttcttgacttatattaaatggaaacagtggaaatagctaaaattgattaattgattacaatgataataaactatggacaaacaaatgcataacaaataattaatctaaacaattatatgaaaatcattctaatcaatttctccccttttttaaaatttatttttatttattatattttttattatattttaacttctagggtacatgtgcacaacctgcaagtttattacatatgtatacatgtgccatgttgatgtgctgcacccattatcttgtcatttacattagatatatctcttaatgctatccctccccctcctcccaccctgcaacaggccccagtgtgtgatgttccccttcctgtgtccaagtgttctcattgttcaattcccacctatgagtgagaacatgcgtttggttttttgtccttgtgatagcttgctgagaatgatggtttccagcttcatccatgtccctaaaaaggacatgaactcatcgttttttatggctgcatagtattccatggtgtatatgtgccacattttcttaatcctgtctatcattgttggacatttgggttggttccaagtctttgctattgtgagtagtgccgcaataaatatacgtgtgcatgtgtctttatagcagcatgatttatattcctttgggtatatacccagtaatgggatggctgggtcaaatggtatttccagttctagatccctgaggaattgctacactgtcttccacaatgtttgaactagtttacagtcccaccaacagggtaaaagtgttcctatttctccacatcctctctagcacctgttgtttcctgactttttaatgatcgccattctaactggtgtgagatgatatctcactgtggttttgatttgcatttctctgatggccagtgatgatgagcattttttcatgtgtctgttggctgcattaatgtcttcttttgagaagtgtcttttcatatccttcatccactttttggtggggttgtttgtttttttcttgtaaatttgtttgagttctttgtagattctggatattagctctttgtcagatgagtagattgcaaaacttttctcccattctgtaggttgcctgttcactctgatggtagtttcttttgctgtgcaggagctctttagtttaattagatcccatttgtcagttttggctttcgttgccactggcacaagacggggatgccctctgtcaccactcctattcaacatagtgttggacgttctggccagggcaatcagacaagagaaagaaataaagggtattcaattaggaaaagaggaagtcaaattgtccctgtttgcagaagacatgattgtatatctagaaaaccccatcgtctcagcccaaaatctccttaagctgataagcaacttcagcagtctcaggatacaaaatcaatgtgcaaaaatcacaagcagtcttatacaccaataacagacaaacagagagccaaatcatgagtgaactcccattcacaattgcttcaaagacaataaaatacttaggaatccaatttgcaagggatgtgaaggccctcttccaggagaactgcaaaccactactcaacaaaataaaagaggacacaaacaaatggaagaacattctatgctcatggataggaagaatcaatatcatgaaaatgaccatactgcccaagataatttatagattcaatgccatccccatcaagctaacaatgactttcttcacagaattggaaaaaactactttaaagttcatatggaaccaaaaaatagcccacattgccaagtcaatcctaagccaaaagaacaaagctggaggcatcacgctacctgacttcaaactatactacaaggctgcagtaaccaaaacagcatagtactggtaccaaaacagagatatacaccaatggaacagaacagagccctcagaaataataccacacatctacaactacctgatctttgacaaacctgacaaaaataagaaatgaggaaaggattccctatttaacaaatggtgctgggaaaactggctagccatatgcagaaagctgaaactggatcccttccttgtaccttatacaaaaattaattcaagatggattaaagacttaaatattagacctaaaaccataaaatccctagaagaaaacctaagcaataccactcaggacataggcatgggcaaggacttcatgtcccctgttttttaaaatgcttttgattgcaaattatgtgttgattcttgcttaacttggtgggtgtttaaatgggctttttcaatattattttattattattgttttctcaaacattcaataatagcataacattcttttctaaccaaataatatactaaaatatttagaaaaaatatccatgtctactacataataattagtggagggaagaaggccattttgcctactattttgatgttgctatataaaggtgcttgatatggtttggttctgtgtcctcaattaaatctcaccttgaattgtaataatcctcatgtgtcaagggtgggaacaggtggagataattgaattatggggacagtttccgccatactgttctcatgatagtgaatgagttctcatgagatctgatacttttatgaggtgcttcccctttcacttgacactcattctctctcctgccgccctgtgaagagttagctaccaccatgattgtaagtttcctgaggcctccccctccatgaggaactgtgagtcaattacatgtctgttatttataaattacacagtcttgggcatttgttcatagcagtatgagaagggactaatacagtaaattggcaccaggagtggggtgctgctgtgaagttacctgaaaatgtggaagcaactttggaactggacaacaggcagaggttggaacagtttgaagtggtcagaagaaaacaggaagacatgggaaagtttgctacctcctagagacttggtgaatggctttgaccaaaatgctaataatgatatgggcaatgaaattcagactgagggggcctcagatggagatgagaaatttgttgggaactggaataaaggtgtctcttgctatgctttagcaaaagactgtcagcattttgcccctgtcctatagatctatggcaatttgaacttcagagagatgatttagagtatctggcagaagaaatttctaagcagcaaagcattcaaggggtgacttgggtgctgttaaaagcattcagctttttgtaatcacaaagatatggtttggaattgaaacttacatttaaaagggaagcaaagcataaaagtttggaaaatttgctgcctggtgatgtgataggaaagaaaaacccattttctgaggagaaattcaaggtggctgcagaaatttgcacaagtaatgaggagacaaatgttaaccacccagaccatggggaaaatgctcccagggcatgtcagaaaccttcaaggcagcccatcccatcataggcccagaggcctatgaggaaaaaatgatcttttgagccaggcccaggaccttgttgctttgtgcagtcttgggacctggtgccctgtcccagctgtggctaaaagaggccaagataccactcaggtcattgcttcagaagttgaaagccccaagccttggcagcttacatgtggtgttgggcctgtggttgcatagaagtcaagaattgaggtttgggaacctccacctcgatttcagagaatgtatggaaatgtctgggtatctaagcagatgtctgctacaggggtggggcactcacagagaacctctgctagggcaacttggaaaggaaatgtgggatcagagccccgacatggagtctccactggggcactgactagtggatctgtgagaagagggccactatcctccagaccccagaatggtagatccactgacggcttgtaccatgtacctggaaaagctgtagacattcaataccaggccatgaaaacagccaggagggaggctgtaccctgcaaagctacaggggcagagctgccaaggttgtgggagcccacctcttgcaccagtgtgatgtggatgggagacatggagtcaaaggagatcatttcagagctttaatatttgactgccctgttggattttggacttgctggggcctgtagcccccttttttggccaatttctcccatttcgagtgagtgtttttaccagtgcctttaccccattgtatctaggaagtaactaacttgctttgattttacaggctcataggtggaagggacttgccttgtcgtagaggagactttggattttgacttttgagttaattctggaatgagttaacaatttaggggattattggaagggcatggttgtgttttgaaatgtgaggacataagatttgggaggggccggggcagaatgatatggtttggctctgtgtccccacccaaatctcaccttgaattgtaataatctccatgtgtcaagggtgggaccaggtggagataactgaatcatggagatggtttcccccatgctgttctgatgtgtgaatgagttctcacaacatttgatggtttcataagggtcttcccctttcactcaagactaattctctctcctgctgccctgtgaagaggtgccttccaccatgattataagtttcttgaggcctcgccagccatgaagaactgtgagtcaattaaacctctttcatttataaattacctagtcttgggtatttcttcatagcagggtgagaatggactaatactatgcttaactgcctttgcttgctttgagtctagaacactgtaacagacttgctgtccttgtacatctagaattacttttatttagatagtcatataaaaatgactcagatttgctgtcccttgcttcttgcctaccactgaggcagggacaaaacttcatccctggaatcaggtgcagaggattgtgccacactgtgcccacacatgaatctgctgtctgcattcacctcaggacaaatgtcacttccctattgaacctcaccactggacatcctctgactttcatttccctgatggcagggaatcatcaggtgtatttcttccaattatgtttccagagcctccaaagctggggagctggtttctgccagaggagggataagtgaccgcatggactttgaggcacactctgtttatgcagaatcctgtctgttacgacagtgtcaccagtctcttgacccttcttatctcttagctataatcttgttgtttctggcctttgtgttttctagcctcaatacagagaaccagatgagggacaaatactagactgtgacttaatggtgagaaagtagccaggaaaaaaatttaaaaaagactcgggttgttcggagcaatggcaaaaattgctggattggttgaatcctgtttctcctcctcattcttggcatttcatttggactaacactgagaaattttcccactttcatgttaaagcataccctttcaggtctctttagtgtgatcttcttaggtggcattttcaaatgtcttaaattgcgcatcccacaggacagatttgactggaaggatgcggttaccatggaactcaaaagacagcttccagaaagaaatgtatctcctccaaaaacagaagtaaaaactgaaaatagatagagtggcatattttctctccagaaattgaggacaaaaagtacagtatatgttagtaaaatgcaaagtctaattttggtttttaaaacttccttattactttaaatctaatgcatttaatgaattttaattatgactttggccattgcatgagtcatattattactcctctagcacagtctggtagggggtcagtattctggaaatctaatatgagctacttcatgaaactgctcatctgaaactcatgggattgtcaccacactcctcttaggtttctacccacagtaatactatttttagatctgagtaccatatgggaatcaaactacatagaggaatcacagtgcagattctagaaggtttgagctgcattaaaattttgtctaacgttctcaatttacggatgaagaaagtaagtgacaaaaaaggttatctgacttatccagtcaagcaagtggttagaaataaaaccagtgcttgcttttacttttcttattttattttattttttacagtttctggatttcttcttgcttgctttttaattaccaagacaagatttacatcaagggttagtctaccaaagggaaatcatagctctcaaagataggtgatccaccataccgtttgcacttaataacaaaagtaatatttttgtttccaaggcttctgttcttaaaagaatttaagggaccaaggaaggatttagaatgatcttctgtattttataggttgctgagttgggaaaaacgtcatgttataagcaacatgaaaatttagtctgcatgtttagttggcatatgagatggtatttgtagggatgagatgctcagtggttttaccagtaaccagcatctcgactgtccaacttttggaaagtatcatagtttgttataaaaaagtaaaatgtggaaaatagtcatcatgtagttcattacacttggccattataaaactgtttgtgtcatttaagtttaaatgggttctcagtgccactagtgattctttatcacctcaaattgactctaattatcccatgatcactattacaaatgcttcctctcccatcagtcttccaactctgtctgttacgcttgtgtgtaaattggggagagtggtgaaagaaacaaaatcactcgtgactaatttaagcaaaagaaaatttagtggcttgatattaaaagctcatggcattgcaaaaagaatagaggaacagacatgaagaggacaagacaaagccagctccagaagccagaaactgggagctgtgggaatcattcttcggcagaaacctgtcagggcacagctgctaggcagtgtagactcccatccttatagtattcttgcatcaaggttcaaagtcccaggagtaaattttctgtctaagcttaggacacatttctgcctcttggatgtactgggaggtgagaagcacgaattatcctctacagcttttgtaattggaggcaggcacatagatttcttgttgcagtatacacacacacaccttggggctaaggtaacttcacaaaacgaaactgaggcgtgttaagcagtaagaaagggtacagtgtagaaaacaattgttcagttatcttttatattttccttctctgcagatggccacggccttggcttaattaaaaggatgtatgccaattgaaatgaactgtataaattttcctcttctcccattttccatctatttcacatcaaggatccctcattctcggtgccatctacctttctggaaattctatatctcatacacttcctttctcgtcttcagtctcattattacagcctctcttttctcatgactttaagctattcgccttctcatttccaaatattaaaaaccttccattgacctttttctcgccttaaggtaccattaaatgtctccaatttctctgtgaaagtttcaaaagcatatgccacaccctttggctctgctccctcagtgtttactcctccctcccctccacaccacagtactgaacctgctctctcaagtccccagggaactctcccaatatcaacagtcctctgcccatctgcagcctcactgagcgtccagaaccccgttggctgtaggtcttttcttgaaaaatagttcccttttcagcttttgcagcattacattcaatttttaaaatgtctctgacttcttgttttctgtatttctcctggaactttttctttctctaacaaattacatgtgggtgctcatcaatgatagcatccttagatttgtcattacttctatttctttattccacaatctttattgacctgcggaacatgaagatgtgcggctgagattccacctgccgtaaggaatatggtgctccgtgtttccctggtgctgcctcacgtctctttcatgaaagttaccattttctttttacactagctagtcatgtatttttctctagttttctatggattgcaattttctggagtttatgggactcttttattactttgtttaatatatgacaggtgctcagtcaataattgttaaattaataagttactacaggggaaaatagacaccctaataaaagtctgtagaaagatggactataatataaacaaagataattaagcataactttatgacacactaaagttttatgactgtaaccacaattatttactgagcttcctgaatacaaatatttggatttgtttccatattgagagtctgtaatagtgaggagaccaagagataattttacatattgttatctcttttaaatattggggattcattttaaaattacgcatcctgaaaataatgggagaacaaagttttttgtaacagaaattaagtgccttttttggaaaaagtaaaattaattcattaataattgttagttgtctatgagaaaacaacagggccagtcttttaaatctttgatttatcataattactctatttatagtttggctatgttttttatcaaaatatatttcccattgatttgtggaaaatataataacatagctgaatagcaaataaatgattacatatttttaaagtgtgaacatctgcacttggaacattcacacatagaagaaaatgtgattgttttctgtaattataatttaaataatatttaatacaaaatgtttacagtgtttttttttcacaaggcacttgtctttcagtcttgctgataaattttctagacctaaaattagaaatgacaaagtacttaatgtaataaaggaatgcctgtgtgtgacatttaaatctgagtaccaggtaaatgattttttttaggacctacttatgttacttcattaaactgagaaaaaaacacacattgtccttcattacatctgaaaattaacatatctatctatctaatcaattgaacatagctaaaacacacacagacccagataaataaaaataaaattgtattattttatttaatatcttattcttcttcccccaaataccttaaataaaatcagcaggtatctacttgcccagtgaacaattccatttcttttgatccctttatgaaggttaattagtatttatctgtaaacccagagagtatagtttaattcatcctaataagacttgttagaaagaactctgatgatcacattttggtttcacagaagtgtaaattttagaattttattttcacaggagcgttataccatctgtctacatgttaatttattgcttcaaatgcattaacttctttgcaccttttatttgtcacataaatttcggcattgcttacatattaatccttgggttcctaggctggcattggagaaactttactgtaagtactcaaaataataactcaactttaaagatgggagtatttattaatattatattcactatgatcaaaggaatttataatgtttcttctaattctcaaagaaagccaagtaaagagagtttattatacaaccttttgaaatatcttaatttctttctttgccttagttatgcatacttcaatttgcatggcaactcatcatacccacattataggaatattttagtgtgtcctgggttgaagccaagatggctgatgcctcagacagaaagacacacatcaaagaagccctggaagcaattttaggaagttcctggaaatagaggagaagggtgtaagtctggagtagagtagtgaaggaggaggtggagacaagtgttcagggtgacaccacggtgcagagttggttccagagagcttgcagaggtgtgtagaactgaaaggcatgagccacaccctgacaaatgtagacctctgtaaactgtgcaaaaatgagagaagataaaaacatgttacttctagtattgatttcaaatgctggcttggctaattagccaggaggagaaggaaaggccaatagaagtaaaataataaatatgtggaatctctgaggtgaagaaaagaaaaaaaccatagagagattgtgttttataagccataattgtaaattcccagtggaatgagtcagacattttctctggaatgcatatgtcagagataaaaataatgtgttagttgagctttagtaataaaatgatctatgatctccttgggaatatctggaaggaaaaaaaagaaataaaattttttatttctgcagcaaaaattgcgagcagatcacagctattctcatacaaaatggtcactagagattgtattagtccaaggttaaagagtcataatgctattaattttgcacaaagactctgaaataggcaatattcctatacgggagaagtaacagcatagataaccctgggatagaagaagtcagaataagccaaaaatgttgtgttggtgaatgaatataggggatagtgtcattacttgagaatcaaggtaatgagtagaaaagagagaaagctattgtgaccagggttaaagggaaggctgaaaaatattcagaaatcaggaggaaaggcagctacttgttagtaagattgaattctttctttatttttattttttttgagatggagtcttactctgtcgcccaggctggagtgcagtggtgcaatctcggatcactgcaacctccgcttcctgggttcaagtgattctcctgcctcagctttccaagtagcttgaattacaggcatccactaccacatccggctaatttttgtatttttagtagcgatggggtttcgccatgttgggccaggctggtctcgagctcctgacctcaggtgatgcgtctgcctcagcaacccaaagtgctgggattacaggcctgagccactgcgcctggcagactgaattcttttgaagacaaaaattccaaaattttggttcgaactgtttgctcaaggtaaagataaagtgagaaagataaataaggaaagactggagaagcaccagaatactctagcatacaaataaaccaagcaggaggcatgggattaagaagatgaatggttctaaagatgccctagaaatatgatattaacatgattaagataataataataggtactcacatttattgaatctttcctatttgtttgtcataaatgttttgtgtgatgggtgcttttatttcattcttacaacatctctttaaaaagatacttcttctaatccctgttttatagagaggacttcgaggctttgaaagaccaaagtagttgttcaggattaaagctagttaataagggaaacaggctcccaacttagctgtctaaccataggagaaccctaggaaacagagttatacacagaagaaaagagagatagttttcccaaagagcaaattttcaccatgacatagggtgtgggaacaaggagaagttaaaggagagaagcgatgtagtgtaagagaatatatttaaaagaggaaattctcagggttctagatagcagtccataaggagagccatgagatttagaatgtaaagtaaaaacttaagaagcttttaattgcaaaaataaatattttatatacattatttttattgttgtatcctctgtatttggcatagtgcctgtcacatagtaggtacgtaataacattttgagtgaataaaggaaacctgatggttgaatgttcagtgtcaacaaggtagcctaagatgctgaattaaagggcttaggatagcttacttacacagggactttttaataatgcattgttgtttgatatttgaggaattgaattactgccctgaaaaaaattgaaaaaaaaatttgacttggttcaagaaaaaagcagatcttgtattttaaagtgaagtttagatgctgtattctggctcaaggaaactaataattaaggtcaatgacaaaacacatcaaagtgttgtatattatttggaattatagcactaatcacactatactactatggcaattcagtttgttaattaattggtgaataaaagaaagtaaataacatgcctaatcatggagatgaataagtcagagcacagaatctggaaccagatagcttgggttcaaatcccagtgctgcaaattattagctatgtgaccttgtgtaatttttttaaagcctatactatttcctcacttgtaaatggaggtaatgattgtacttgcatcatagacttggtaggaagattaaaagtaaaaggtctagaacttgtgaattgtttagaaaaatacttggcacaaagtaagtgctctgttagtatttttttttgtttgtttttgtttttgttttttttgagacggagtcttgttctgtcacccaggctggagtgcagtggcatgatctcggctcactgcaacctatgcctcctgggttcaagcgattctcctacctcagcctcctgaatagttgagactacaggtgcgcaccaccatgcccagataatttttgtattgttagtagagacaaggtttaaccatgttggtcaggctggtctggaactcctgacctcatgatctgccctcctcggcctcccaaagtgctgggattacagacgtgagccaccatgcccagatgtagttttgttgtttttttttaaataaataaatgtgatatatctgtaagtgattaacttacttcctgggtatatgtgctccctttttattttgtgtgtcctatacacagaatcacatattattataaagaaaagacttttgaagtcatttacatttagctagcagatcaacataatattaggaaaataaacaagatatactttatttcatataatctgtataaagtatgattacaactgtgaaaaaatgcatagataaaaggtaagatgaaaatacaataagccattggcatttatgggtttgaatagcgagatttttgacaaattgagagtagctttggaaatctgtgaaatgtaattgtttgtgattttgttaggcatgatggtgtttcgaagtaagtcattagtgactaagtcaagtcaaatgcctggaatcagcatttagaatactatgcatttattgaaatgtaatcacagcatgtgaaactgaaaggtacctaggaattagtgtagaccaactcaagtcatcaataatacaagcaattgtacaatagtaagtcatcaatagcacaagatcaagctgaactgacactttcctgaagtcatgcaacaaatgagaacagaaaaggatgaatgaaacttccagagaagtggatcattcattcattctttcatcaagtaaggattcaacatttacaaaaattgttactgagtaataatgagatataacaggcaggtcatattctggaccataaaataagtcacagtatatttgaaatgattgaaatgatacataacatgttcctgcatgaaacaaaattaaattagcaatccgtaacagaaagataactggaaaatcctcaaacatttggaaactgatctcaacatatttttgaataacaaattaaggaaaatacaagaaaaaaattgaaacaatttgaaattgaatgaaaagaaaaacatttgtcaaaatgtgtcggatgcaggtaaagctctacttagagggaactttatagcattaagtgcataaattgagaataacgaattagtgaaggaagaattttccaaaacaagttaatgacatagaaaacaggactgacaaagggtgtttcactacagatactacagacattaaaataacaataaaggactgggttccagttccacatgtaaggagtttggaaatcaccattacttcctaacaacaaataacaagctgaacagattgaaaaatcaacactctggatctagatgacacagggcaaactgttgcctccaacactggagagacagacaggtgaaagcagggagttagtcttgccagatcaaagactcatgaggataagaaaacctgaacaaattgctggaggcttgatgtggacaactctggggaccaaaagctcgagagaaaccgagtcacggggacaaggcacaatattcaccttcacaagttcaaccagatggacctggttcccacagtaaatatcagagaaaaattccattgctcttctggcagggagaggggaaaatgaaccattttgaaatacatgagagcactttgttcttaacaagatatttcctaaggagaaactatttaaccagaaccaaatgtgctgggatatgatcagaacctaactgatctgggggaagggaaataccccacttcaatcggctgtagcctttcatgtgggataaggaaaatacaaaccacaatagccaatacatcactttgaaggaaaagaataaaactgcaggactgacccctgacttcaacacttactacaatgcaacactaatcaagacaatgcaatattggctaaagaatagatcagtagatctatggaaatagaaatagatcaatggcaacaaatagtttaatggaacagaatagagagcccagaaatagccccacataaatactgtcaactatatttgaacaaaggagcaaaggcaatataatggagcaaagattttttttttcaacaaatgtgctggaacaactgtacatccctaggtaaaacaatctaggcacagatcttacattattcacaaaaacgaactcaaactggatcacagacctaaatgttaagtgcaaagctataataatcctggaaaataacatgagaagaaaaactagattaccttgggtatggtgatgactttttaggttcaacattgaaggcgcaatttatgaaagaaacaaacgataaactggggtttattaaaattaaaaacttctgccctgtgaaagacaacgtcaagagaaagagaagacaagccacacattgagagaaaatatttgcaaatgatatatccaatgactgttacctgaaatacaccaaggactcttaaaactcgacaggaagaaatttaaaaatccccgttaaaaagtaggccaaagaccttaacagaccccttatcaaataaggtatgcagatggaaaataagcttatgaaaatatgctctacacttcatgtcatcagggaaatgagtattaaaacaacaatgcatacctggtagaatgtccaaaatctggaatactgacaacaccaaatgcagatgaagatatggagcatccaaaacactcattcattgctggtgggaatgcaaaatggtataaccgctttggaagacagtttggtggtttcttacaaaagtaaacatgcttctgtcttatgattcagcagtcacactccttgatattttcccaaagaagttgggaacatgtctacacaaaatcatgcacatggatctttatagcagctttatccttaatttccaaaatttgaaagcaaccaagatgttccttagtaggtgaatggattaacaaacctggtacatccagacaattaaatattattcattactaaaaagaaataaaccatcaagccatgcaaaaacacggggaatccttaaatgtatataattatgtataagaagccaatttgtaaaggctacatactccatgattctaactatatgacattctggaaaaggcagaatggtgatagtaaaaatatctttgttgtcaggggttgagggatggagaggtggagcacagaggattttcgaggcagtgaaaatgctctgtatgatactctaacgataggtatgtgtctttatacatttgtccaaatcttaacatgtgccacaccaagagcaaaccctaaggcaaactatggactttggatgattatgatgtgttaatgtgggctcatcagttgtaatgagcatgccattctggtgggaaatgttgatagtgggggaggctatgcatgtgtcggcataaggggaaatctctgtaccttccttttaatttgcctgggaatttaaaaccactctaaaatatagttgttaaaaatgaatattgcaaacattatggcaatagattaaataacttggataacattttaaattctgtgaaagacttaaactactaaagttcactgaagaaaacatataaattgtaatagcactatagctattaaagaaattgagttttcaattaaaaatttttccacaatgaaaattctaggttcaaatggtttcagtggtgaattctgccaaatatttaaggaggatgtaacgccagttccacacaaactgttttttttaatagtggtttcctatcaaatcactcttctactgataacaaaatcaaagaaaatccaaagaaataaaactacagacaaatattcctcagcagaatagacaaaaatattctatatgccagcaaatacaatcagaaattaaaagtaagaaaaaaagtctcaaaaactaccaattgtaatagcatcacaaaatatgaaatgttaatggataaatttgacaaaaatatttaagatgtgcatgtagaaagataaaagatttatgaaagaaagtaaagaagaactaagtaaatgaagaaatatatcatgttcatggattggaaaactcaatattgttaagatgttcattctcttcaaattgatctatagattcaatgaaataccaatcaagaacccactcagattttttgtagaaatattctaactcattcttaaatttacacaaaaatccaaatgacctagaatagctaaaacaattgtgaaaaagaagagcataattaggtaatttacactatctgacaacaatacttatcattaatcaaggcacttggtattgccataatgttagaatacagaacagtggagaacactagagagcccagggatggaaccacatctatatagccagttgattttcaacagtgttttcaaggtaattcaatagtgaaatgatcatctttttaacaattgtgctaaaacgatatccacatgcaaaaaagtactctttcattattacctcatactatataaaaaaaatgagaccaggcacagtgactcacgcctgtaatcccagcactttgggaggccgaggcaggtggctcatttgaggtcatgagttcaaggccatcctggccaacatggtgaaaccctgcctctactaaaaatacaaaaattagcccggtggtagtggtgtgcctgtaatcccagctgcagctgctggggaggctgaggcaggagaattgcttgagcctaggtgcagaggttgcagtgagccgagatcacaccactgcactccagtctgggtgaaagaaaaaaaagaaaagaagaaaaaagaaaaaaatgaaataaaaaaatgaaaattataggtataaagaacaccaaatagaaatttctagaagaaaacgcagaagaaaatctcagtgatcttgaattaggcaaagattacatgaatagtatgcccccacaaagacacaaactataaaacaaaatataatgaaatggaattaatcgaatttaaaaatgtttgctgttcaaaggacacttgaagtagtgaaaagtttggccatagaaaacatatttgtaaatttttattaaaaaagttgtatccaggatagtagaagaacccttacaacccatcaatgagaagaaaaacaaccctactcaaaaattagcaaaaagctgggcatggtagcccatgcctgtaatcccagcactttggaagttggaggcaaatgtgggcagactgcttgagtccaggagtttgaggctagcttgggcaaactggtgaaaccctgtctctacaaaaaatacaaaaaattaactgagcatggtgacatgctcctgtagtctcagctacttgggaggctgacataggaggatcatctaagcccagaaggtcaaggctgcagtgagccattaccgtgccacttcattacaacctgggccacagtcaggccctttctcaaacaacaaaaacaaaaacaaatggcacatgaaaacttgctcaactttattttattagggaaatgcaaatgtaaaccacaatgagtatctctgtaaacccactagaaggtcaacatttaaaaagtctcagcacagcatgttggcaatggtattgataaaatggaatttttttttctttttttttcggagacagggtctctctctgttgtccaggctggagtgcagtggtgcaaccacagctcactgcagcctagaattcctggactcaagggatcctcccgcctcagcctccccaataggtgggattacaggcatctgccaccacagctgactaattttttattttctctagagacagggtttcactttgttggccaggctggtcttgaactcttgggctcgaagagtcctcccacctcggcatcccaaagtattgggattacagatgtgagccactgtgcctggccaagaaaatggaacttttatacattgctggtggcaacataaatttgttcaattttggaaaataattttgaagtttcttatgaaattaaacatgtgctttcataaaccagtaatgtcactcctggatattgattcaagaaaaatgtgaaggcatatgctcacgccaagactcataaacaagtgtttacagcctctttatttgtatcatcccaaaactaaaaaaaaacaaagtccattaataaatgaattgataaacatattgtggcgtattagttcaatggaatactattcaccaataaaaagtaatggattgttgatatgtacagtgtcattgataaattttaaaataattatactgagtgaaaaaaatccacaaaaactatgcatagtataggattttatttatataaaattctagacaatgcaaactaaacagtaatgtcaaagaagagatctcgtgctgccggggtatgatatggaggaaactatggatcacaaagaggcatgaggaaacttggaagggtgtgatggaaatgttatctatagtgtggtgattttttaatatatgcatacacatttgaagtctcatgaaattttatactttgaatttatgcagattattgtatttcaattaacctttaatacagctctcaaaaatgtctactcaatacaatcaccagaatcagtgaaatggagaaaaggaaggaagagagagagaggagatgaggtgtagagagaaagatgacaaacagaaaatcgtatttgcaaaaactcacatgctgatattcatggtgcgggtataattggtccagtgactttggaaaaacacaaagctgagatgaccctattcgcaacagcaaccaaagctttcaacacgagacataaaatttattttttaaatgcaaaatttgcatgaaatattcactggatatacctgccagaattgctcgaatgaaaatggagactcatagaaaagaaaaaaaaaaagacaaaaacataaaaccttgtgctttgagtaaatggaatgctaatgtaatactgatggggatttagattggttactaaagctgaacattgccacgtgctccaaagcaatgtgtgtattgtttacgaaagtacttgtacaagaaagttcaaacagcactgtctttaatagtcaataccagaaagtatatagatgttcacagcaatagattggattaataaattgttctaaattaacacaatgagaacactgctcagcagcaagaataaatgacctataactacagggacagatctcacaaacataatgttgagcaaaaataaattaaaaagaatgtattaatagtgtatgattcagtttctataaaatccagaaacagggagtctactactatactgttagaagacagggacggttacccttgatggaaaggggtgacctcaaggggtctggcagagtcatctggcactgaaataatctgggtgctgtttacatggatatatgcagcttgtgaaaattcactgggctttactcttgcaaagtgcacacttttctctatgtatgagagacttatgaaaaagtttttaagggaacttatagcctcagccaaaaagttaatctatggaagttataaattagacataaatacaaaactatgctttggataggaagacttaaaaatgtaaaactgtgaattctgccttgaattaatgtacacgctatgtcagttacaaatggtaattttagattaacagagtaaacatgtgaatatttaatacttttttatagaaaatatgctactttcatcttatttattcctccatctagttatttattttatttctattttatagaagatataatacattataaatttggaaaacaaccttaaatttatattagggatagtgaaaaataaaatgtctttaaactcacctctagcaatcagatttatgtatacatgttcttttttttttttttttttttcagagtctctttctctctctcacccagcctggagtgcatggtaccatcttggctcactgtaatctctgccttccagattcaagtgattctcatgcctcagcctccccagtaactgggattacagtgtgggccaccacgtacagttaatttttgtatttttagtggagatggagttttgccatgttgcccaggctggtctcaaactcttgacctcaagtgatttgcctgcctcggcttctgaaattgcttggattacaagcatgaaccactgtgcctggccagtatatatctgattcaaagttgtttttttttttagtttgaattaaaattattgaacttgtttctctgagtcatttaaatgagagaggactagagttatagatgcgtagctatataatttatatataaagttatttttatatttttatcctttttatttatcctttatttgccctttttatccttatttttgtatttttatcctttatctaaatatatatttataattcatatgtatttgtcttttctctctttcactcaccttatacaagctccaatattgtatttgtgcctttaatttctttataaagagtaaacttgaaatatcctttgaccatgctagaggattccattatattcctgttttatatatgcatgttattagcaacttttggaaatgcttattttcatggatctaaattcatttaggatgatacagattaatgaagaaagttggtgctgttctctggcctagtgtttttttttgttacaggccttttcacatggatgagatatttatgtgaggaaatttctaggaaatgagatatttttcctagaattcaccatatgctttacacataaagagtagccttaacattcacttaactttcctctcaaaaggattgaaatactcatggccaaaaaatagccatctgcttaaacatagtagctgaccattaaggaaagattttcctggttctactcctagaggcactgcatgggaggaagaggccatgaagtgatgagtgatctttactgttggtgtttaagctgggggttctgcttgcttgtcaccgaagtaactaataggaaaatggtcagtataaattgacagcatagaccataatatttggcttctagagatattttcattctgtgctacgcttccctctcatctttgcttttggaatattttaaattatggattcaatttctctaacaaatatagtgctattcagattgcctatgtctccttgagtgaattttggtaatttgtgtctttcatggaattggtccattttatctaagttatcaactttgagggcatagaattgttcatagaatctagtatattcttttaatgttcatagcctcagtagtgatgatccctccttaatttctaatattggtaatttgtgtattttccttcttttgttcttaatcagatggctaaagtttgttaattttatcgatttttttttcaaagactcagctttcagtttcattgatttttctctattgtttcactcttttcaatttcatttacttttacttgtattgttatcttctcacttctgcttgtgttgggcttaattggctcttctttttctagtgtctcaagacaacagcttagtttatttattttagatctttcttcttttttaatatatgaatttaaagttagaaatttccctctaagcactcctatccctgcattccataaatttcaataagttgtatattcacttttatttatgtcaaaatagtttaaaatggtctcaaaatgtcatttttgacccatgtgtcctttagaaatgtatagtttattttttaaatatttggtatttagcagctattttgtgttgcctactttttacattagagcccttgacatactactcatggttattttaaattcctggaggcacagcatggatggttttgttttgggggcatctagttcctagctgtttgaagtttcatgatataggatattatttaggaaaaccccagggcacttcatctgtattcttgtcacatctgtcttggtgtcaggaatctaacaagaagtaggaatcaagtgagtggggagtggggagagaatcttgtctagatattatttctctgggttcatttggctcttgcttctgtagcatggaaggacattcacctttctgtacttctgctacacagtaaacatagacttcatagaagcgtatggatatattttctctaggacaggaatttcatggaacaaattatactgaattaaaagtgaatgacacaaactgagtttcgtgttgcttaactagtttggcactaatttagaagattacattgcctctaccttttgttctttgtcgcttaaatgcacagacacgccattgattcccagactttaaggctccagcctctgaagtttttgcaggtttaacttaaatttctttggatttcttttttagtatatttctttgtgactagtcatatttttaacagctttattgaaagatgattgacatacaacaactacacatattaaacatgtataatttgacatttcaacatatttatacatccatgaaaccataaccacagttaagacatttaacatgtatacatccttcctcagctttcttcatgcctcttgggaattctttctacctgaacaaccccatctcctccttccatccccaggcaatcactaatcttccttctatcaccatagattagtttgcattttctagaatttcagataaatgaaatcatacagtatgtacccttttttgcttctttcttgcagcataattattttaagagtcatcatattgtagtgtgtttcaagaatttcttccattttactatcaaatagaattccctttcatgcatatattagatttgtttatttgttcactcgttcatagacatttgagtttcttttagtccttaactcttacaaataaagctgttataaacattcttataagagtcataatatggacacacaccttcgtttctcttgggtatacacctagatgtggagtggatcgatcatatggttgatatatttttaagtttcaataaatttcctaaatgttttccaaagtttcttttaccattttgcatttccaccagcagtgtttgaaagttccacttccttcatgtcctcaccagcacttggttatgttcacctttctttagcttttcttttttttttttttgaaacagagtttctctctgtcgcccaggctggagtgcaacagcatggtctcagatcactgcaacctcctcctcctgggttcaagcgattatcctgcctcagcctcccgagtagctgagattataggcacccaccaccacacccagctaatttttgtatttttagtagagacggggtttctttgtgttggccaagctggtgtcaaactcctgacctcaggcgatctgctcacctcggcctctcaaagtgctgggattacaggcaagagccgcagcgtccaaccctttttagcttttctaataagtgtgtagcgatgtcacattgtgattttaatattcatttccttaataacttataatgttgagctctatttatatgctcatttaccattcatatatttatttggtgaaatgtttgcttaaatctttggccgacctatttacatagcctacctctccagtgatctaagtctttaatttctcttggcaatagtttgtagttttcaagtgtgtggttctagaccatttttttcagatttatccctacatattttaagttttttgatgctattataaatggtatttttaaaatttcaatttctaattatttctaattggcatctgcaaaaacataggttgctatttttttaatctttcttccactatttagaacctctagtatattcatgaatatacgtggtaaaggcaaacatccttgttttgtttctgatcttaggtggaaaacaatcagtcttttatcattaagtatggtgttagatttagctttttttttctttttttcagaaaatctttatcagcttgagagagtttctttttattccaaatttgcagagagtttctaaaaacaacaatggatattgcattccctcaaatggcttttcctgaaagtattacggaattcagaccacgtgcatctaatgttattactgatatggttaggtttacatctgtcattttgctattttaattttgtgtttatttcttctttgttccattttcacttcctgtttttaattgatttttatgcttgcattttatatcttttctatgcttgttagctataactactttgttattgtcctggatattttaatgtttatatattttaacttatcagaatctaccttcaagtggttttgtacttcttcacatatattgtaagaatcttgtaattctttgcttcatttctctcctctcagtcagtactgaaatgtattgtactgaaatattctgtactcatacattttacttttcacatatttgtatatcacatgctatatattgcttgtgatataattgcttgtgcttatttttgtttattgaatcaattacattttaaaatatttatgttaatttttacaacagctttaagtttatagaaaaattgagaagatagtacagagaattgccatactatttacacatagtttcccctattattagcatcttacataagtattgatacagacaggaagcagggaaatactgggtagaagagggcagggtcctgggtgagggctccacccacaagcctggacctcaggccctaaataagaatatgcattcctgttttcctgcccgaatgctaccttttacaaaacaaccctggcctgccatgccccctccaaaaccactctgacctcccatgcccccaactctgtacccataaaaaccccaagttccactggcagaggagcagagcggtacagcagaggagagaagagaagaagcatctgaatgttgagaggagttcaactgggaatggccgaactccaggcgaagattatcttcccactccatcccctttccaggtccccatcctgcttccatcgctcagtaaaaatcctctgcatacaccaaccttcaatccgttcatgtaacctgattcttcctggatgctggataagaatttgggatgcactgtgtgcaggaacccaaaaaggctatcatactgactcttcactgagctgtttgacacttaagccatcagcagacagcaaagcaaaaactgtttgtaacacatgccctctggggctccagaggtcgtgggcaacccctagatgctgctgcgcgctggtatggggttctttcctgctggtgcccaaaagcacttgccatggctcctgcacccactcacctatgtgctccccctcccacaagcagtttgagcaaatgagccaggggctgagtaaaggagtcacaccctgttgcaagtcccacaaaggaatcaagggaactctcccatctcagtacggtatatttgttataattaatgaagtaatactttgtttttaatcaaactgcatattttactctgactgtcttagttttttacccagtgatttttcttagttttttaccttaaaaaatcccttttacccaggaaaaccacataaacattaatttatcaatatatctttccttttttgaataattccttttttcttgaactaaaagatgttccagatttatcttgtttatatctcatcccagtcctagaatcagtcatttgtccaatgatctctgtttccttctgttggtgagtggtattaaaaagcaagagcgagcgctaggctcttacgtgctcctgtttgctagttaggtgttttcattgttgccggagtgtcattgcttcctctcagttgagagagaaaagaaatatatatgtgtatattaacctataatatgtacatatttacaaatatttccatgtgtaatcatcagtattatattaacataagttcttaaatcttcaactctaatccattaccaaatggatcattctagcctccttcccttgctgatttataaatttccactccaatagtgagaagcctcaattgcatcatctgtcatctatttacttaattgttcaattccagtacattaatctagtactattagaattgttatcctctaccccagtagaaaacaattttgttgactagaatagagtgcttatgttcagttccttttgccttatgtctcatagacaccattcatttccacagttatttcgttcagcaccttactctcaacctcttaagtttttttcatacatttgtaatacagttagattctcttgtaacagtctgcattctttcctgggatcctctgtcctaatatattatttgcatacatttgttgtactgtttgtgtcataaagttttataagttttgcaaatgcaaactgaacttttgaacatttggactatagttgtaataactgttttaatattattgcctgctaactatcatatttagttgagatctggttctgtttggagagattattttctttctttttgagagtatattttcctacttcattgtatgcatagtaatttttgattgcctgctagaaattttgaaatttttcttttttagaaaaaatactgtggaactatgttccaggatgcagttaattacttggatataatgtaatcttttcaaagattccttttaagtttgttggttgggaccagagcagtgttttgtcaaattattttaactactgaggcaaaactcttctcaatgtctaccctgtgacttgagaattatgagatgttctacccttactggtagaaacaaacactactatttctagctctgtgtgagcaactggtgctattccttttaatcctttcaggtggttctttcttgaggtttctttatgtgcatttgtgaatcagtgctctgctaaatactgaaggcaaaccctctgtggatctccacacttctctctttgtgcagctctattccctcggctactctgttcttttaactgctgctgtctaggtctctccgtattctccgttcaatctttcaactcacggagttcagcactctgcctgggtttttcttttttgcaccactgcctggaaattccttcagggcagtaacaaggcaattatagggctcatttcatttgtattccctctttcagagatctttgtattttattacatactgccctttgtcttggaaacaattgtttcatacattttgttcaatcttttgttgtttcaggtataaaggtaaatccagtcctagttattcaatcttggcctgaagtaatagtccatccaccagtcattcattagattatttttttctcttgagtcctaggattttcacctttctaagctttcattgctatcagataaaaagagttcttgatgaaacagactctgactttattcctcttttagttcgagccttcatgtaatttctggatgaaacacctctactctgtcctcatatccttactttcttactgtttcttcttatttgtttgccttttattcttttcctaagaaattgatggtgtcagtatctttattctagatacacttatcttctgctatcttgtgctgacacatatttatttccaaagtgcctctgctaaaatcaaaactatatcctcagaactttcaaaaatttcagtttacctgcccaagtcagaaatgtgctttccttgtgctttttcctatttctccttttataggagtccctttgttttaaccttgtgagatatttaagtcaactggcagcctgcatttagtttcaaggtaaagtgggtatctatagttcaaattaatgtggaacaattataaaacatattgtataaatactctttgatagtgaaatagttaagagtgtttaggcttacaacaattgtttgaacttgctaagaaggcttaaagtttttatttttggtaactgagtgatattaatatcataatatcttcacacaaaagtactacttagaaataaaacctcagagtcatgtgagttctcaagttgccacaactcttatttgttgggtattttcctttccttttttgttttgaattccttggaacataaccccttacataaaagcatagaacgactccactggtaatcttattaattctttgtaaagagtaatgaagatttcctgattttcttacttcttgatctcattgtttctgtggctttgcaaagctaaaaaaaaaaaaaaaaagaacttgtttgaattcccaattattgtctgatttgtgttgcactattatttaatacttccttaatattgtgataagcttcaactcaagattttagccaagattttagttaaggtaaaaaggaataaaagaaaacctaaagcttcttttgttagtactttcctgtaaacttagctctagagtattttattaaataatcttttttgatatcatgccaaaaaagccttatttcaatagtatttttgagttgaattgaaataatcactctaaatatgtattagttattaaggatagaagcagcaaattattcataaagtattttaatctctttgaaccaaaatggtttgaaattttttctttaaattataaataataggagaaaaaatgaggcaatcagttgtaacattcaatagtgttctgtagtcctgtataatcaggtttttgtgggattcaagttccctaaaggagaggacgttagatctaagaagaagcatgatattggcaataactggatgacccatttggggtacaatgttaatgaaaaaaatatatttattgcgcatcgattgagacattttgctggacattacataatctattcgttgctttgaacaaggtgatatatcttttctgatttacatattgctgtaaggatgtgtgaaatgttttattttattagcattttgacattttcattgaagtttcaagatttttttccttcctgtttccctgacagcagatggaaaaggactttcctctttatattttaaaggcagcagagtattaaacaaaggagggaaattaagtgctatctattggtactctgaaattattttccaaaccccattccttttgtttttaaaaataaggccaaatacattttcaaatttgggagtgtaaatacttattactaatataagctctaagagcctccagactgaaaaggcttggaatgcagatcaaacatgacacaataaagggctagttcactttttctttgccctctccaataaagtggaaatgtattagaattttcagtagaatgaagaatgaaacaagaatgaagataggtctttgctctgaaagaagacttaaatttttaaagccaatctttatttggtctctggcgattcatttatctccgtaagtatccattggttcttatcagttcattttctcattactcctttttaaaaatgtaagccttccaaaatttcctttttttttcttattctctttactctcaatattttctcccccaggttctcacacatttccacttatttatttattcattccaaactgatggagtatctgttacatcctaggaataatgccaaactctaaaaatgaaaagatttcactttctggtctcatccttttatttcacagctagtaagatggccaaagccccaattccaagtattatggggagttcaataccctcccctgggagcttattttcttgtgtttgtctctgactctgaattcctgctctgactgatcttttaatatccagtcacttcctggggctaacatcttctttccatattgcttcacccagtgtgtggccactgtcctcttttttttgtttcttaaggcaccaccgacatgtgtctgttgcataaaacaggttttactggaaactaagtgataatggaggatgataatagtgcaatacagaatagaaaattatttaaattcattattgaactgcaaaccaaacaaaacacggaatgcaaattatattttcataatgcgtgaactggacttgccaatcacaactgatttgcatattgtgccacctgttggtgcagcaaactgtgtgggtctgaagggaaatagattgacaggctttctcctccttactccaaagttgctgtttccaagatccccattttacactagagaactaggtactcttccctcttcaatgtaacctgaatattattccctctcattgaacattaagagtgtttggacactcatttggagactacagtcttttttttttttttttttgagacggagtctcaccctgtcacccgggctggagtgcaatggcacaatctcggcccactgcaacctctgcctcctgagttcaaatgattctcctccctcagcctccagagtagctgggattactggcgtccaccaccatgctcagctaatttttgtatttttagtagagacaggatttcaccatgttggccaggctggtctcgaattcctgaccttgtgatccgcccaccttggcctctcaaagggattacaggtgcccgccaccacacccagctaatttttgtatttttagtagagacggggtttcaccatgttggccaggctggtctcaaactcctgaccttgtgatctgcccacctcggtcccccaaagtgctgggattacaggcatgagccaccatgcccagctggaggctacagtcttcagaaaacaaagtgtcaggcaaaaggagagaatgggctgcagtgatatgctgtatcctaggaagaatatttctagtaagaaaaattgttgaaagtaggaagaacacatgcatgatagggaaatcagtttttaacatatataatatagatatacatattttatgttacaaataaatatatagtatcatatgtgaaattatatataaacatatataatattgtatttatataatacatacgaaaaatgtaaatacatacaattttatatatgcaatatatatgtaaaatgagtatccccattctgtaggtgcccttcctacatatatgtttcatatatatttacatacttatttattttacaaatatatatatttcttgcaatgcatcagataaacagatattggggtctaagaaaattccacctgagattatttatggtgaaatagttcagactatttttgctgtcaggcatgtgtcacccagactctttcctgaattccaaacctacttttatcttcttcccacatggtgtattagtatatcaaagccaacaagtccaaaatcaaattgcctcaccccacccctgtttgtggtcttatttttgtttttcctgacgtcatcctttaatcatcctggtttctatctcctctcttcccgttgccctcacatccacgattttgttttcctaaacttcttgtgtctgcactcacaaaatgttccattttttcctctgtcttgcatttccattgttactcccttgtcacactaatttcttttcttattaaatcccacggtggtgattgtaataaacttctaataggcatgtctctgttccctctctttatagcttagggttctaaagtagagtttagaatcatgtttttctcctgatatctctcaggaatttggaaagaatgaaagaaggttgtcttctttcgtgctgagtaaagcttccatgtctcttcacatctttcctttaataactttcttgaaggtactgttattttttatagaagcacatgagggtggatgtcaactctgtgttgtttagttacagcctttactccgtccatactcaacaagtcactattctctatttatgagtttgctcatgctagtctctctcccagaatactccccattatttcattaccatatcttgctcatcctcacatgtctaatacatccaattcttccagactcaaatgagataatatctcttcccagaaatctagtaggaccaatattcctttcctcagaattaatttaacactctatgttttactataaatatttctgtcttctctttcatatcagacaatgacttactttggggaagaagcagcttcaacacaataagttccaatatatatttatcaaataaaagttataagattggcaaatattaaaaataaaggcaattatgaagaaatgattattagtatagtacaactgttttcatctttttgtcaatgaaaccgtttccatgttaatctgggcagtctagattatgctgcagtaacaaattaactcccatatctttgtgacttaacatgtccatggattatttttggtggtgctacatgtccagtgtggatcatcaaatgatcctccattgctattcaaggcactgggtcaacctctacgttggctacgttggctaaacctctacgatactgcattcgccaaaggtagatgagcatccatgttctcatacctatcatccaggcttttgcttagaagtgacacacatgtactctgttgttaatccattggccagaattagtcacaaggccccatgcaactaaaagggggctgggagaattgggaagtacatggatattgaataattgaatatttggtacaatgtctttattacacttctctaccagattaattagtactgtacttacctttggataggaaacataccttatatgtctggataagaaacatttttacactcttaaatctatacaaatttataaaatgaattacatattttgaaattaatacatttcacatgcagaaataaatatcaagcaatgaaatttcaggcagttcaataccatttccttgttaaagaatcagtcaacaacaaaatctaaaattaaaatttatcacttttcctcatatgaatctaaattgtatatatctgttttcttactcttccttttatttgcacacggagatttttaaaaattccaaaaattgtaatagctcatttgctttatggcatcaataatagtatttattagacatttatgtttgttagttaaaaataacagtatttattattgtgtactaaaaacatgtgtcaagaatgatgtatacattatctcttgaaatttcagaacatcattgctcggttgtaggcaaattgttaatattctcattttacgtgtacaggattgaaaccaaaatggaattataattttccaaaattaccagttagtgcaaggtaaagccagaatttgatcttcattatgtgtaactctagtctctaaattataatctgttttcgggtaaattactaaaggcatctattacaactaagtttggctctttacctccagaattttcggtaatgtattgattttaaacactgtaagacagttggatatttttcaaatgtaggtataaaataaaaaggaaactctagggcctcccatttaagaactctgtcatctgatgagtcccagaaggaatgaaatagttttatttcgttgactttcagaggtaaatggaaagatagttatgttggaaaaggcttttcattaggggctgctattctcaaaactaggaagacaagacagctacaaaatatgctgtcatttaaaattatacattattgcaaatgttcaagaaaaaagcttgagcgctagaatgcggagagtcactagattatagccttggtgttttgacaactagtcaagaaagggaactctgagctttttgccaattaacaatggaaaagagctaggggctaagggtaggcaaagagaaatgaagatatgaacttgggagagaatgaaagaatttgatatcttttgcagaacattgtactttgttaggaaactatagcagtttccccttattcgtggggatacattccaagaccctccagtggatgatagtgccatacctggttgacgttgatcagagcacgtttctgttcacatcttccatccacaaatttaatggcttttacatcctaaagcacttatcacgtgctacagctgtaacttttgcagtttgaagtgagataagcaaaactagcataaatttttttccttcttcacaatttcatggatagaagatgtctccttatcatagatcttaacctcaactataatttttgtctttttttaattaaataaagaacttccatcttttcacttaaaggaagcattttatggcttctctttggcgtatccaaattgccagcatcactactattgtgctttgggtcattattaagtaaaataagggtgacttgaacacaagcactgatactgtgacaatagatctgataaccaggaaggctactaagtgactgagtggtgggcagcatccacagcatggagaggctgatcaaagggggaggcacgtcctaggcagaatggaataagaaggtgcaagatttcattacactactcagaacacagcacgatttaaaacttatgaattgtgtgtttctggaattttccatttaatatttttggactgcggttgaccctgggtcacagaaagagcagaaagcaataatgcatataagtgaaattactgtactctgagcatcttaaggaaaggaatttgctttaatgggcatgtgaacaagtagaaactttgtttctagactgaaagaaaggaggaccatccagtgggtagtttcaaagatgtgttgaatggcatattctatgtgttttcctttattacaccaaactgctttctacttccagcctgagttacttttttggcttggtaactttctgcattacttctttttctatatgttttagtattgtttgagctaaaaagggagattcgttgattcttggctcttacttatacagcacatgttgacaacaaaaatattccaaaattcttatttgtttttgacctcaaaatgaggccatgtaagacaaatgcattaaacagctcatcttcattatttcattgtgactaagtcacaatgagatacacatctcacagttaacgaagactgaataagcaggagcaagatctgtatatttttattaaagtacttaatataattgctacattctatatctcaatttcttgatattttgagtaaaatcctattataagagcttttgcacatttatgaaaattggcagaatcagtgaaatagagtaggagaccttattcttcggtatagacatttctttaattgctaagaaaaaataatatttttccacatattaaaagttatacagatgtaaccaaatttgcaccatataatattcttttgaaagtgaaattataatcactcacttggtatctaattaatccagagtgcctctcacgttaaaggctttacaacctgggcaaagggaatattggcttcgggttacaaagataaattagccagtgactctggggacttctctctataaactccttcagggaagaatcaatatttgaagtttcttttcaatattcaagaggtttataaactgaagttttaggatcttaaaataggatttcatgttgagcctcataaaacagcaaaaacgtgtacaaaatttggtaagttttcaaatattcatttgtcgggtgatagaatagaaggtgtaaagcttttatcagattatcaaataagcctatatgtacaaaaaatgagcattattgaaataatagtttctttctcttgttttcaatataaggcaaactggaataatgaactaagggcaaaattgagagtagagacacgatgttacgacacattagggcttgaaaagaacaattcttatgggggtggagggtgttatgaacttgagggtgactaatatttggaaaagtgaaatagaggaaatggcagtgagtgaaaacacatggtcagtactttggggacagcatttttttctctacttttaagtatgacaaaaggtatagtacaacttacatttgaaggcagcttggaggcagattcatatattctatcattcaaataatggagagacagtcaaggttttttagcatgggaataatgtgattgaaaaatacctgcttatggtgattgtcttgacaatactaaaaaggagagctcttgaattatgaaaattaattggtatctgattgtaatggtccagataaggattactaaaagtagaaattgtgaaaatagaaagctacaaattattgcagaaatttcaagaagagaaattttcttggtgaggaaaggggaaagataaatctgaactggaacctgcatatttagttctgttccttgtttcaagaagatttaaatgtagttataatcagtaaggggataaatgagctcataagcacaacggtaactctatatatgcatagatgcctacattgttaggtgaacatttaggaagaatgagaagttagtaatccaatgtatcctttactcaagaatgtgaaataatataatggtgggttccatgtctgttagggaaacgtcgaaatcaatgctaggaacctcatgttatccctgtaagtaaaaaatttacattccaagttaataacgtgggtcacaccattgtctactatggcaacttgtgtgtatttatcgtaattataaactctatgctgagaagctgttggaaacaaaatcctatatctcatttacatagatccaccactaggaaagaaaattttaggaaaacacacagtttttgtaattaactaataaaatatttttaattgactactatcacaaaataaaaatatgtttctctttttttgtagtcaattttaaagcagtaagtcaagaaaatggaattattaaaggtgttagctgactttagaaaaagaagagagctgaattaagctggtataggtcaaaaacaaatgcaaatattatgcaaaatataatacagctcctttctctagccattatagctgaaaaaagtgcttaacatatttatcacctacgcccctcttcatccctcttcttaggaagtagcaattgtctaaacagagttttaaagaaaataaattcaatacctggaacccaagagatacttttaaaatcttgacagtgataaggaaatctgacataattatttaaaagaaagctaagaggcattggaggaattcttaattaattttagaaaacttggtttttgtttaagctacaagacttctttaaccttcttttcatcatttgtagagtcagaaagttggacaatgatcactaaggtcttcctgagctctaataatattggattttaaagaatgaaagaaaagcaaacatgcaatagttttatgtgtgagaataggcatctataatctgcatagagagaacaacactgttctattattgaaacctaaaatgaacaaatcaacagaagaccaaaatcaaaagaagacctaggaggatatttcatatccttggtttcatacagtgacaaggaaccatgtcaccgttggaataaatgtattgttgacagagagtaaagcaggtttgagataattcagtcttgtggcagaaggaattggaaagactgccttgtcttctcaactaacattggagatctcatgacatctgtgtttgaggtgagggttttgttcagaaaaaggaacataaactcacaattttatatttctcatgttaaagacaaattattttgacatttgttaaaatggcattgaaggttttattaaaagcttttgcaatgaggatcaagactattgccatagtgaagagagattaggctcaactctggatacaacaaagagaacttgggatttacagccaaggagcagagtgatgtggtcagtggatgagaaattaccaagaagagacattaagggtagctgctaattgtagctaaggacttatgtatcaaaggtgggggatgaggaacttgcagatagcaaaggtggggtggattctctccggactgatttatcaggatgcctgctaaaactaggctaaccagattgagaacggagcacaaggatgaggcatcctcaaagggagggcccagagaagcctgtctaaatttttatcaagaagggagtcgtcattagtcatgactgtatccagtcaccttattttacaagggaaattgcttctaagcgattatctcaagaagtggctacataattttggcctcagtataaaatgaaaatgtgggacccttgtacaaaaattaagattttcaagacgatgacagcagaacatcaaaccaagtggtggtttcttctaagcatagcacctagttcagctccacaggttgcctgcctatgaagctcgcctgggtcccaaactccttcagagtaggatttatggctcacatatctgccaaagacctgaataaatgtgttgaaacagaaacccagtaggtttaaataagttcatgagggtcactcggcatttcagtcatggaactaggattacaaatgagatggtcagatgcagtgaacttgcctcctcattgttttgtgctctgaaggcaggggcctctgttcagtagatttacatttagcttaagcatgttcctgtcaagaaaaaaatgaatgtaaaaggaaagacatttatattggagaaaccaaagttaatgatattttttgtaaattcctccctattttaggtgaaattagtgtttatattctgtattttcttacatgctcttcatctaggaaatcctgcttcttctttttggcaagcaaatattttccttgtgctcatgggtatagatcaatagacctctttagtttagaaattcagagattgggtatatccctgaaagatttcctgcttgaagtttgctatatctacctaactacctacatacatatatatacatataaaatatgtaatgtgtttatacagaaaatatatatgtaatttatatattttacatatataaaattaaagaaaaattatgcatcaattattaataaggaattatcatttttataattaggtaagcaaggattgggattaataatgctttcttttttcttttctccatagagccattaattcaattcatattaaagtataactaaattgacctataaggtcaatatttaatcttctaaattaactgtggtatatagcatcatagagcagaaaaaagatggccatggaaatgtaaagaactatgtttattctctctgttttttaaatttttttagacacaggatctcactcaatcactcacgctggagcacagtagcatgaaggtcaaggctcactgaagcattgaactcctaggctcagccttcagggtggctggaggtgtgtgtcaccatgttcagctaatttttattttttgtagagacaagatatccctatgttgcccaggctggtctcaaactcctggactcaagcacgtctcccgcctcagtgttgggatcacaagtgtgaaccaacatggccagcctgtttatttttcctatggccacttaccatgtaatgtgtgtgagcatcaaatacctcacttgttaaaaaaaactgataacagtatctgccctttcctcactacacaggattgttatgagggccaaagtcatttacatagtaacacctttaaaatctgtaatatatatattgtttaaaatagcagagtcaaaattattttacatacgttaatgctaaatttgcttttggagaatcatttaaatttaggaagccttaaaaacataataggaaaaaggaattctgtacaaaaaaattgctgttaccatagggaaattaaaaaagctatctttttcaaaatatttttaaatgttttatctatgcaacaccaaaaagaactaaattttaatacccagaattatgaatgtaaatctatctcacatcattaaataatagtgattcttttaaatgaaaaaattattttggctacatgtatattcatgaaggagcaccctatattatcttaaaataatatgatgaactggatgtttctaaaacaataaatggaatgacagctatggaaactagaaaactcattttctgtaagcaatgtcagatcatatcttatattttacttctccgtttttcagaatcagtagaaaagatgttaaatctcttcatgataattttaaaaatcagccttataatccctccatttataaaaatgttatgttataaaacaggctaacattttttcctatgttaatatgtagttataatttagcatggatatgaaaggttattccttttattgaaaatgttttatttgactgaatgtttcaacaacaacacattgcagaagtgtgctggccctttaatgctctgtttctgttgtcatggaaataagattttcaagtaggtttatctgctgggctttgctttttatagacttcctatcattttaagttggttttagacaagcatccttatccttcaaataaaaacactaatctttattttaccatatttcttaatatttttcccaataggatttctcaagatcctggagggtgggggacgttccaatttccaggcgcgtacattaaatatgaatgtttagctcctggttctaaaaacaaagatttaaaaaaaattgttatgatgacaaagaattccagaatccatttccaattttaagcttataaaatgtatgttactctcaaattactgttaattatataaatacaatttatatatgcaaatattttgtaacatgaacagaatcatgtaacttactcatgttgcttatctaaatgcaaccttggcctacatattccttcataatttagcagccacttatctttagaattcatttttatagagagacagattaggttaggatctgtttgctactaattagttgtgtgactttgacaaattagttcaactatatctttttcaatatccttctctgtaaaatagggataataagtaagtaataagcagagttattgtgacaattacatgtgttactatatgttaaggacttaaaaaagtaatttgagcccaacgggaactcaattaatgttatatttgccaatgttttgctattattgtctttcactattttctaccgttctcctgttcattcttcaagtgcattaaaacttttgctgccttatgacttagccctttggatatatcattgaattatcattaacacttttctctttcatgctggattcttcacttccttgcctctataacacttggaaattctgtatttatttatttatttttgagatggagtttcgctcttgttgtctccagctggagtgcaatggcacgatcttggctcactgaaacctccgcctcctgggttcaagcgattctcctgcctcagcctcccgagtagctgggattacaggcctgcgccacaaggctacttttttgtatttttagtagaaaagatgtttcgccatgttagccaggctggtctcaaactcctgacctcaggtgatccgtccgcctcggtctcccaaagtgctgggattacaggcgtgagccaccgcacccggactgcatttattttattactcgtttactctctattcttccacatgcaaagagattcaatatgcacttattaatgtaatgaataatggagaaaatttctttaaattggcatagacatttccccttttttctaactcactaagtaaatactttaaagattgaaatcacccccagattttcaaatgaggcactttcctatgtcctgaaaaaattatgatgggttagatttaacgctaattatgagaaactcttttctattctatggtcagttgtagccatagctgtcttctaatgtctatcaataaagctaacgaaattatttttctcccagtcatattggaaatagctgtttgttcttgatgaattggttttaacaatctcattactgaagaatttaattgggatggctctactttagacgtaagttacattggtctctctcgcttcaggaattataattttcaattttaaattcctaattttaattatacattaatctctaaagatgtcatggtagagtaatattattagctaggatctcctataaattcttttgataagtttgtgtatcttttgatggcaataaagacatcaagaaactctttggaattataatatatgaacaagctaaatgggaattaacaatgattaataacttcaattataaagtatttttcttgaaatctagtgttcaagactagtctattcccacagtgaaaatgtttaggtggtacctactatgttggtaaaatgtctgtttctgttcaaattatattttctcattttaaaaaaaaagtgttttttatttttgaattgggtttattatatattcaacatacaagttcattatcaaataatataaatactgctctcagtctgtcatggcttgactttagattttcttgaagtgtctttcaaaaagagaatgttttacttttggtgaagtccaaactatttcttccaggttttcatttgtattttgttttgcttaatttttatgcaaagtgttttttaaaattttaatgtagtagaatattttaatcctcttcgttattgcctgtggaatgttagtcttagttagaaatgtttttccctttatccagttgacaaaggaattcgttcatgttttctttagcacttgtttgattctatttatttgttttcttctggttcatcaggagtttattctagtgtataatttgaagtgttgagtcaaattcttctttttcaaaatggctgtcttgaaccaataccatttatttaagtctggctttttaaataggctattaatgcttactttatattggataatcttaaatgaaaagacactagcaatattaagaccaaagtaatagcagagaatatctcctcaaataggtgtttattttgattattcctgaagtcagatccattatcatatatagattaaaattttcagttgggcatggtggctcacaccagtaatcccagcactttgggaggctgaggtgggcctgaggtcaggatcacctgaggtcaggaattcgaaaccagcctggccaacatggtgaaaccccatctttactgaaaatataaaaaattagccgggtgtggtgttgtgggcctgcagtcccaggtacttgggaggctgaggcacgagaatcgcctgaatcaggaggtaaaggttctggtgagccgaaattgcaccacagcactccagcctgggtgatagaacaagaccctgtctcaaaaaaaaaaaaaaaaaaaaaaaaaaaattcactgctagaaaccaccatatcctttgttcacataaagttttcctaatggccaggaaggggtaacagattaaatgtgaacggggatgtagtaacaacacttacttatatttgtttatattcagtactgctttattggagtagactactgactttgttgcagggaactagcatttagtgcagtagacagaaaaaaagttgcagctttccttatttagggtagaaatagatatatacatcaccctatcatccaagcttcagacagtaaaactgtttgaacttgaaatgcatcatgagtttcaagttcaaacagttttactgtctgacgcttggatgatagggtgatgtttatttctatttttccatgagggtaagagaaaatctcaaattaaatggtaaaattctcatgaatagatcaagaagtgctttactttctttctctcaatcccttttcttggaaaactcaagcagaactgatgatgtaagtcattattacaggggtgcgtgtgtgtgtgtgtgtgtgtgtgtgtgtctgtgtgtgtgtgtgtgtgtgttttaaccaaggcctactgaacggctattctttattaggagctgtggtaggtgctttggagaactaaagaacatagaaatttggtgttttctctgactgcagatattccttttgttaaaagcagattttattcaaaagttgtaccattattgtgttttggtcataggttggatagccacccttttattcttgcataattttgtacttaacaaagttcttaagctaaaaatgtagaaaaacacagaaaaaaatagcgatctccaagcttataatctagccacaaaggcagatgaggacatggatgactatctaataaatgtcaaataaaataattaaatcctataaatgtcacagagaagagggatcattggttctttttccataaatgaggtcctcttgccgttgtccctgtctcatttgatagcaactctctgtcagtgctcaggcttagaaccctggtgccagccttaactctttctcacctacctcacaggcgggcttttaggaaattctatcagtatggtcttcaaaatattgccaaaatttgtccatttctcactaaccccacagcccctcttttggttggatccatcattctctcccttctgggttactgtagtagctctctagcaggtctctctgcttccgttcttgctcccggttattctcaacagcgcagcctgctgtattagtttcctattgctgctgtaacaaattaccatcaatttagcttaaaacatcacatgcattgccttacagttccagtggtcagaggtctgaaaggagtctcgctgggctaaaattagggtgtaggcaggttggttctttctggaggctctaggagagaatctgttctcttgccttctccactttctagaggttccctgtattccttggctcctggccctttccttcatcttcaaagccagaagcatagcatctttcactctctctctctctctcttgctcttgttcttactctatttgtcacatggttcttctctgactctgatccacctctctcttttgatgtcctttatgattacattgggttcatgtagataacccaagataatcctcccatatcaggatcctcaacttaatcacatctacaaaatccctcttgctatgtgaagtaatatatttacatgttctgtggattagaacacggacatcctgggggagttgttattctccctgctatgcctggtgaagccattttaaaacagataacatcatgtcactccttagtttcaagtcatctaatagttctaatctcatgttccataaaagccaaaattctgtgatctacaaagctggacataatataccccattgtcattgtaacatcatattctactttcccttctattttttttttgctcaagctgtgctgatgttcatgctgttttgggggcattttctaacatattcctgccttaggaaatttgcattggttctttttattctgcactttttcaaagtttttacttaaattcatgttctcattgttgtcttccttggccaacctgtctaaaacttttaccctacttctgtaaattttatacttttcctctatggttttttatttatctcttcagaacataccactatgtatcatacaatgtggtttacttattaaacattttgtttatttgtccaagaatgtaatctccaagagggcagatattttgtccctttagtttactctttgctctccatcacctaaaaaaaatttctgacatgtggtacacctcaaaagacattagttgagtgaaagaatctacgaaaggaataggatctgaggagcagaagaaaatggaaccgagacagaagaaaaattaggcttgctgtatgtatagaagtgcactccaggttgagagaggatggtgattagaaacacagagggaatcaagtgttcagggaatatcagtaacagagcataattgggtagagaggtagagaaagccagatactcgccaaagattcctactctgtctttataatgtggagctgttcctgggaagtggctgccaggctgaggaccacatttctcagccccctataattaggcatagtcacatgatggagatctagccaatggaatgtcagtggaaccatgggcatctcttccaggccagacctacaaaaaactttccacgttctacacctttatgctcttctctttctggcttttgggtaaatgttctgaaagcccctatttttcaagcacatgcatataaaaatatttataatatataaattatgtattatatataacaggtttataaagtatatattatatatgctttattatataatgttagtaaatataattatttgaaaaaataatatattatatatagttaatatgtactgtaaagtatatattatatatatttataaagtatatattatatattatacacaaacatacaagcatatatatatatatatatatatacacacactcacacacacatatacttgggtatgctaaaaggggttgaagtacacacaccaggagtcaatattggcgcttcttggcagtatagtggtggttagaaatggaggacagagaaggtttttaattttaaatatatttttgtatttcatcctccagattttctggttcactaggtatacagtaagttttgggatccatgttttcttaaaatcttctcagatgatcaaaacgtacagtcaggtttagaagatgatctctgtctggttccccaagacagccatattcttgaagaggtaagctttttgagaaagatggtatactaaagttaataaaagtaagcaagtcaatttccactatgagataaaatttacgtttcctaatcatttagattagtcttagtgtatgatattctcatgtgctgtttatatatcgatagggtccaaaggagaagcacggtacagtacaaagacctgggctatgctgtcttattggggatttctgaactcccaataattggcaatttttaacaagcgcccaagataatctggtaaagttcggcagcactgtcttctcaaggcatgaatgcacaatgagatctcatggtgagctcagcaggagaagctggagaaaagataaagaaagggaagaataaaggcagcgtagttagttctaggacagaaagagtaggtgccatgtggctggtaagggagctcttgactcagtgtaaataccagggatgaaaagaaatacacttaccagtaatcaatctttatgcttctttgttcttctctttctttgggagagatatcagatgcaaaagattaaggaaggctttaataaaattaagaagagatgtatttttgttttctaatagtagtgatggtaataatacttggaagattggttataattatcatttttatgactcaggctctctcagctcttgttagtctaaacttataaacagttgttttttttttaaattcttggtaagggaaaagtgcacaggtgagagaatgctgatagtttaatccgttccatgcaggattagaaatatagtggagacattgtgtacatactcaagcaatgtgagtttacagcacacattcaatacaaaaggagtaaagaagagaaaatcagtctgtgaaggtcagagatgcaaactgtgaataggctagtggactgcatccttgagtcagggtactgaaaattctgcactctttttcactttttaaagattttgtaaccacccatgcaaacaagcaagccaagaataaaacaaactaaaaaaagcagccgaacaattctaagggatggtggagtcttttgtccttttgtggaagcatatacttgccctcccccactgccaggctcgaagccagaattgaggcgtagggacattctatagcagatttttgcatggttttatgaaagccaggccatcattttcagattaaaggcctggcaaataaacagttgagtaaatcgtaacacatctctctcggttgggtagtcacggcctctttggcagtgctgcctctgctttcctctgaagtcactgcaggtgtcagtctctctgatatctagtagggtagctacacaaaacctaataggaccaactttttctgaaacgcactagctcagagacggcgttacagcacttctctggaaggacttgggaattttttagcccagtttcttcacttacaattcaagaaatcgtggtctcaatcttactgactcatgtaagggcttatcagactgattttctctctgctctcttctctctcagacctagtaactgctgcttggtttgatgccctgggtatagctgatttgaggttcccaccagggacccaaaataatttgtgactggtggttaggcagaaaagttcagatgactgcaaggaatcacagtttctgctatgactcatctactgtcagggcatactgtttaaacattttgtcctttaatttccatattagttaaataggaaaataatatatcttaattactctactgggaacaacacgaagctgaattagacttcaccaaaaatatttatttgttttcatgtttataccttgccttattccaaagaagttacctgttatctaggaagatataaaagcatgaaggattgaagattgctctatgaactggattacggatgtggtaaagggatttaaaaacaaaacataacaaaacaaacggactagcattcagctgcgtctctgcatgcttctacagagtcctacaggtggtaaggaggaggagctgggacaaagggtccaccttgtttcacattctataatttttgctatggaaatctgcctttgtcactgatttctgtttttcatcattctgtcttctttctttagcccgcccacccccaggagtctttatccatactaataattttcaccagaatttcttactgatgatatttttgctttttgttaagagcctctccagagaagacatttatcatgccctactcagctcctcccatattctgagaaagcaatcttaccttttgggggaaatactccttacactcactccttccctcgatggaaatgcttcttctttctggtgttgctttgaggtacgaagctagctgctgttggcaattgtatttcctgcttagtgggaaagtctgaaatggagatgatggcttcgcagtgcagaaatagtagaggctggaaaccatccttattgtctttgggaaccggcattcttgtgatccagatgttcccctgtcctgacatgtccactttgtggatgtgcaccatgaaactccccatttgattttaggtggttgtagctggttttctttctcttgcattaaaagagccttcaataatataacagatcaatataatacttgtatgtgagtagaatagaaatcttgcatggtttgggggaattagaaaatagagatcaagacataaaacattctactatttgtcaagtatgtgaaaattttctaggacaataaaataatacccaagttaatgcttccttcctgttggtccagctatcactaattccttctgccagattctaaacagactttaagctcctgtgggtagataacgtttacttcatttctatgtttttagtacctaccacaatttatgatgcataataaaaactatatcaggaactttgaatataaataaatataacatattgtcttaaaagaaaaatccttaaaatagcaagtatttcacataacattatattctacattattttgctttatcctccttgtctttataaagaaaaaaatactactttcttgtttagctgaggttgaggtttaaatctcaaacacttttgaaaaatcaagattagaaaataattttggagtcacctggctgaagaataatagtttgttatttgtttgtttgtttgttactaaatgagttcctgaattctttgagaaaggaaataggaaagttagagagccagaattttaagaaccaaagagccagggagttggcaatccgaggaaagatcaagggggctctgatctagataagggagtatcagggaaggtacttccagcattaagaagtcaagtagaattaagatggttaggccaggcacggtggctcacgcctgtcagcccagcactttggcaagccgaggagggtggatcacctgaggtcaagagttcaagaccaacctggtcaacgtggtgaaatcccgtctctactaaaaatacaaaaattagccgggtgtggtggcacgtgtctgcagtcccagctactcgggaggctgaggcaggagaatcacttgaacccaggaggaggagcttgcagagccaagagctaagatagcgcactccagcctgggcgacaaaagtgaacctccgtcaaaaaaaaaaaaaaaaaaaaaaagagatggctaaatgggccttaacaagttctatttgtgacctttgagaaaacaatattggggaaatgaactgaagggaaatcaaattgcaggggactccctaggaggtggagaagggtgggagtagcctgtcaatgaatctaattaagcacggatttgttttgcaaaacagaaaaagatgttactttcttgacatggggcccatcaatggagtattttaaatttcatgctaggaaatttgtgtttgaagaattgggagattggtctgttcaaaataaattactgtctatagtcaggcataaagtaatttagactttgaaaatgtaagcttagtgttttgagcttttatttaagaaaatgtaccgaagaagtcaatgttacaataagcagagcacagccattcaaaggtactttcaattttgactaataattctacctttccctttcttggtgtcttcaggctaaagtatataatctattagattcaaattcttttttttctatccagtgagtttaatttatccagagtgtggctctgcagggatttgcagtaattaaataaagggcatttctaccactccatgtgttttgataaaactctggctttaatttctagttgacaataaaaggacaagtagaaatagatgctaataatagacattagtcccaatgaaaaggaattgtatttttttaaaatagacaaataaatgagataaaggagtcaaataaactcagcaatttagatttcttttccagtttaggggataaataaaaattgtccaattaaatcaaagttgttccacttcctttttttttccccaacccagttagtataggggtatatatggagatacaggcaaaagtgagtcaggatatataaacgaacaaatcaatatgaaaaaaaaaacagaaataatggagattctaccaatgaccctgaacaaacacattgagtgaaatcagtaagtacagaatggcggcatgcatacgtgacatatatagtaagaaccttctattttatttatacactctttattcaaaatggatgaaagatatggacgctgaagaaacctacttgctttgaatctcaactctgccatttattgccacttatgagtgatatgatcttggtaaatcacttaaatcctttatgccttagtttttatatgaaaacaatgggcgtaatattagtgaccacctaatagaggtatggtgaagattaaatgggatgatatatgtgtgaagaacagtgtccggtgcataaaaagggcttatataagcattagctactattattacatcatcattattttatatacactttggcctacatagttataacatataaagttgtgaatagcattcgtgtatttatgtgtctaaaaaatgtgatgtagcaaacgtgcccaagtttaatgcaatcagactgtggcatttaacacaacctcactgagtgatgctcaataaaaataaaaaacaaagtgattttcatcactgctagctcatgggccccaaactcacatgaccagctcaaccatcaccacccaacgatagatctttgttgattctcatgcccccacctctccatattcatgtgcattttcctcccttctgtctcattctctctctctcctttctctggtcctctgttccctgcctcaaatcagtggcagtggatctattaaactcagaggatggatgtccacttcatgcagagccaactactatgcctagacactgggcttagtttgacctcttttgcccagattacggcaattataagaaattgatcttatagtatccaaatctgagattaatatgtattacataaaactatttgtggcagattttgcattaggttttctagtaacctgcatttagttttatggtcacaaaatgtcatgtcctccatttagttttatagtaacttcccagattctccaagaaaaatgagtaagatatatatatctatatatatatcttatatatttcctatatatacatatatatgtaatatatatacatatatgtaatatatatatgttttatatgtatatatatatatatattacataaatgacttattttggtagtttttctgaaataaggttattgaagtgtccacatgcaaaacctggaaactgctaaaaacccccagcggacagctctccaagtaaaatagtgagaaaaacacgttttcacttggcatccaactataccactgacttcactgtttaactgactttaatattttatttaacttaagtaggttacaatttccccaacacagtgtctttaacaaattattgttggtattaaaatagagagttgtattttttaatcatataatttaatctaaaaggatattactaaataatctttcaacttgaaactttccccctgtcttgatatgattatggttataactaaactatatcgagtccattttctatttattttagatgtacaaaaagtttaacattcttggccaggcccagtggctcatgcctggtggctcccagcactttggaaggccaaggcaggtgggttgcttgagctcaggatttcgagaccagcctgggcaacatggcaaaacccagtctacaaaaaatacaaaaaattagccagacatgctgcacgctggcacatgcttgtagttccagctacttgggaggctgaggtgggaagattgatttagctggggaggtggaggttgcagtgagccaagacggtgccactgcactccagcctggacaactgaaatcaaaccctgtctcaaaacaaaacaaaacaaaaagattaacactatttataattttaaaatttgaaatgtttgtaatgccaatataaatttacagtctttctatttatgtaaatatattttatatcattaaaagataaagtttattgtaattaaaatttactttgcaaatgtgaatttctaaatcattttgataattcataagatctatgggttctataagtctacttataattactgcctttgttattattattttgcttattgtatttcaaatgttcatccacagattcgaatttagaaatctgttagggccacagaagtaaaaagattttaagcaattaagctaattttattaacctaattaaaaactctttgcattaggggattaaagagcatttgtaatatgaatactcttacaaacataaatattttgtttgtaaacagcagaatcactctgtaaagaataacaattgtcttcaaacaacacagcaagattgtcatcttcttagtttttttctatttcaggaacaattaaaatacaatttaaaaatgaggccatggaaccatccaaagttcaagcacataacaaattcaaaatatgccccctgctaaatttttgacacaattaacaatttgaaaaactcacgtgctttcaaatatttccatgtggtttcttagcaggctgtatcttgccttctaccctgactaataactgttacaagacaattctacttggtgataaaatttgttttggcagacctgtggcatgagcaagtatagaactgacctaggaattgccaagccagatcagtccactagtttttcaaattgcatatactgacctctgagaaatcagtatatgaatatacaatgttttagggaaaaagacctatttataaatactcaggataacattattttcacaaaagcacattgcttcatcactcagaacaatatacagttgatttaaaacctgatatttcatgatctgaggcctttctcttagcttttcctagtttatgggagaataaattatttgaactgacaccacatttgaggccagaggaagaagcagactaatgtttactgagtgccaaccatgtctgtgccaaaatttgtgcggaatgcatttgatcctcactaaatccctgatgaataggtattcttttcctcatttacgaatgggaaacagaaccttaaagaggtcatggaggatgaacagggctggctgagctgccatttgaaactctgattgctccttacagaacatcatgcggaccaaaccaacagagcctagagaatggcccgaaggcttgtgcgcaatgagaaataatccagctatttgttctctaagcctgttgaataaatagctaattggtttgcaccctttccagcctgcttcatagaagcagtgttatgatgaagagcgcaggtttaagaaccagaccttctgggttctagtcccagctctgccgtttactagctgttacctggaacaagtcacttgttctgtttctgtgtttctttagctgcgaagtggggataataatactatgtacctcacagggttattttgaagattaatgaattaaagtgaggacataaatgctaagacctgcggttggcatatataagctctaactaaacgttttgtattattacatgagttatatcgggtggtcttactgagctactaaatatagttgacatttttttctacagcatacatgcttcactgtttcctgtttaaaatggatataattacatcatttttgtatagcattttatattattcaaagaaatttttcatcttctgtcattagagaatctatttttctgaagccccattttcctcgtctgtaaaatagctttaattaatgatacttacttcatgggcatcttggagggataaaatgagatcttgtacctaaaacatttagtgcagtgacttcaccttgtgaagtcagtgagacaagtgttaaattcattctgtatttgaggaagtagataaaaaacatcttcgcctgaagtcgtgtaatgagttagtggtacatcttcacacagagtggagtaaaccgacagattacttgttaataaagaaataaatcaacattaggactcttttttttttcctaaaaggctagtgatctctccattttcttttgctgcctgacttggtatacatgggcatgctggttgtaacatgagtttattaataaaaaactcaggaagctctcttttctgagccatgagaaacttgtttttgttgacttacaaaaggtgttttaaatttcactgcacaaattgcatgtctctgtattcacttctttgtgaaccactcagagaaggctgattattagcaccctcttctaccaccccagttttccgttccatctttcattttatgcatagcaatatttacctcctttagtgaacggaatcaaaagtcaacctaatgtcgaaactactatattaacaactcagaaatatgcaatgaccacataatagtattacatttaaaaagcagtgttttataatggaaagtgtgatagctttggagtcacacagacttgtgtctcaatcttgtccctaattcacgatacacacacacacacacacgtgtacgccactgagcaggggaggagggggagagagagagagagagagaaagagagattaatttctgcattaggtaatatgttaaggtctttcaagccttatggtacggatcagtggccaatggtttttgagactgaatgataagagacagtttttttgtttgtttgtttgttttgagacagtgtctccctttggtacccaggctggaatgcattgacatgaacatggctcactacagcctggaactcagctcatcctcctgcctcagtcccccaagtaactgggaccagaggctcactccaccatgccctctaattttttgagatggggttttgctatgttgtccaggctggtcttgaactcctgggctcaagcaatctgccctcctcggactcccaaaattctgagattacagttgtgagccaccgcacccagccaagacttttttttttaactaaaagtttgcgaatctcttcaacttgacttgaaaatgttcaacttgaaaatgttgtgttgtaccacataaaaataattacaaaagatcccatctggacaaaaagcacattcaagaccactgctgattgctcaagctcattgtcttctttcctttctaacgaacaataaaattctattaatgaccatttcatagtagagattttgacatatttttattattttggctatgggtgatgttaaagattgccatcatctttaggttgacaacacaagctaacagagcctctaaaacactcttcactgcctcattctgatatattttcatcattgcccatgtaagaacctgacattagctccttaatgtatttgtttatttggcctcttacattcctcttctgaaatctaaagaccatgggagcgaggacccagtatatgtgttcatggacttgccctataaattagatttacctctgggcaatggtaagcactcaatatataatcaatgaattaatgactgaaagactagccttgggctggatttctttgggcatattgcatttcctcttaaatcaattattatatagtctgatactactcccatgaaatatacttttgctgttaagattactgcaccccaaggtaacctagtacaattatctgtaaaaccttggcttgtgtgactttaacattcactctgttttttaaggataatggtttttaaattttaaattgattttaaatttacaattcaatttatattcaagattctttatgggctacaagagatatacaagaagagatgcctcaaaaagtatctagaaatttatactggcatcctacccatttagctacaagcgttaagacttaaataaagacatcttttgaagatatatttacatcacttttgcaggaattgattagtcaacatctgtttactttttgtttactgagtcatttaatgtattggaaacagtgaacttttgagagacttttatattcaaattttgcttcctcgtagttgtagaacttgtgaaaatcatttgcttgtctaaatttcagacttataccctgtaaaatagaaataccacttactctcagggttgtaaataataagaaaaaaatatgtgcctagcatacagtggataccacacaaatatttgttaaatattactgaataagaagagctgaacctagtccctggaaagctgggcacctcgcaataggttcaacgtcagtctcactttatgaatggtaagggagaaacaagtgtagctcgtggtttctgaccacaatgacaggcaggggaaatggatatcagacatactgaaatattaaaaataaaaaatgtatgatatctggcaaatatgagctacagacaaatgatattgaaattcaggaagtcagagagaggaaataaatcacatctaccttaatatttgcaatagtaaatgccgaaaacagctttgcattttgtccaggacaatggcagcgggttgcttactgcttacttgagcacatcgctgaaaaccgtgaagaacacttgtaagtggatggggtgtgtgtctgccgcacaagcagagtggagtcaagtggtgtctgcaggttcattcgaaaataacagtgtgcacattgcagcagaggaacgtctagaatgtaaattacttgagtgtatcaatcttcctggagccatggtctggccaaatatctatccaaagagaccatatgtcagggccaataaaacatccttgagaaaatgttttccgggtgtttctggaacacccaggatgtgggcctatttgttttctccttaatggagagtagatcacaatctaaggcctcttgctcagaactgacaaactctctaaagatttcagatgcctaactcacaaaaaaaggaacaatgtgtaaaatcatacctttctctcagaagtaagaaaggaagggcctttcaccttgattgcccattgggagaagtccaggctcccagcctttttagtcattagttcagatgtgttgggcaaggcactttaaagaatgagaaaagttgtcagtctgagttttcttttttgagataagaatttttaggttacctaaagtgatctctggaaatgtaagagtacactttaatgtatttttttcatccacagaggacttgcaatttaacgtataagcaaaaataccaaaacgcttatgataaagctgagaaaacttgagtcttgtttttcctcatcagtcctctatgcaccatatagtgtaatcagctttttcagaggatatctcctaccatctgcatctgcagtgagattcaaagcaacaatttaaaatcactgtttcaaaattcaggacttatggcaagccactagttttgcataaagttgtatttacacccctcccccttgtctgtctttttctttctctcttgcacttatctatttatttttgcaagactgtcatttgcaatatccaatatgtaaggttaggcttaactgacgtatcttattgttaaatattggttcaagtgaatggagccaaaaaaaatcatccacttttcagataagttataacctatgttcattgttgttaatatagcactaagcctttactcaaaactgaagaaaagctaacatgtgttggctaacaactgtgttaatcaagtattgaatgacttatcttttgagtgatataagtttagtattagggaaaccaaaattcaaatctcagttcctcattcaccagctgcgtagccttgagaaagttgcttaacctttgaaagcctcaattttctcacatgaaagaaagctatcttgcagaggtgttacgaatgttagaaaaaaaattataaaaatcgccagcccaatgtctataacattttagctgcagttagtggtaaccaacttattattgtcagttttgtaaaattattaagttttctgataattaaaataatattgtacctatataaaaagtatcaaaaagcatgtaaagagatgagaacacatggacacagggaggggaacatcacacaccggggcctgccagaggctgggggcaaggggagggagaacactaggacaaatacctaatgcatgcaggtcttaaagcctagatgacgagttgataggtgcagcatatcaccatggcacatgtatacctatgtaacaaacctgcagttctgcacatgtatcccagaacttaaagtacaatgttttcaaaaaacaaaaaaaaaagcatgaaaagaattaaataaattatctcaaataccactttctagaaataagcactcttaacattttccaatagatctgtataggtttgtttcaatgcatatgtttatgaacattttaaaatacaaaaggatactatttatactgttgttatatacttctatcactttattgtgaacagcttttcattgttaatacagacaacttatgtaatcattaactgctatacagtattcccatttttggatataccaaaaattttaataaacgattctcctaaagtggacagctttttaaaaaggcattatgtatgtttagagaaaaatagatagaaaaggataagatttccaattaaaagaagttttcaaaatattaaattgaaattaaagcaattacatatcatgaccaattctctgtttgggaatgcaaacagagtttaacatcagaaaatctacaaatgcaattcttactttaatatataaatggatgcaatttgtataatcatcttacttgatggagaataaaacattttttctgattcaatactttataataaatgaacctcagaaatgtgtactagaagggaacttatttaaacagataaaaaatgtctatgcaaacctactacaaataacacataataatgaaaccatagaatcatttcttttaaaatcactgctcaattcaacactgtgttggggaccctagaatgcacagtaaaacagaggaaataaattaaaatatatagattggacagttagactcatatttgttttaattcaaatatgtgaatttctacatagaaatttcaagacctatgcattattagaactataggagagtttagcaaatttgcttcttataggactgatttttaaaatccaataatgtgttcctttgcttcagtcaaaaaaagtcttgagagatttagtataaaatacctctaaaagaaatcaaaatacttaggaataaaaacaaaaaaaaatatgcaaagctcctagggagaacattttaaaacattcttaaaatatatgaaaaaaagttctcaacatatggaaagagatctcatgttcatggaaagagattcaattttgtaaaaatgttaattatgtctcattaatctatgaagttaatttaagttcaataaatataagttcacctccccctcattatatttgaaagctgattctaaaatatatatagatgaccaaaaaccaagattaactaaggcactgtaaaaatatatatgttagacatttaattgctatggaattagtattcagaacttacaaataacatctatagaataataccaaaaagcaaacaatactgtgggcaaatgagtgaagggcatgaatatacatttctcaaaagaggaaaatcattggctaattgcaagaaaatgttctcaactttatgagatacttaaggaaatcatattaagatatataattaatactcatgtaaattaaaagatttatctttggtaacatttaaaaattactaagtatagaagacgtagaacagtaggattctcagatagttcttagggaaatttaaattggcacaagcactttgaagggctttttaacacacatattattgaagacatacataatctcctacccaatgattccacacatacatacacctcagacttgtagggaaaattttaaatgtatgcactaaacatatataaaaatattcattgtaattttttacagttgtttagaaattagaaacaatattaaatgtttatcaacagatccgcatatacattaaaagattgaggaagaagttgcgaaaagagacatataagaagatattcttgatatctaatcaaaacctacaaaacaggccgggtgtggtggctcatgcctgtaatcccagcactttgggaggctgaggtaggtggatcacttgaggtcagaagtttgagaccagccggccaacatggtgaaaccctgtcactactgaaaatataaaaattagctgggcgtggtggcgcatgcctgtaatcccagtacttgggaggctgaggcaggagaatcacttgaacccgggaaggggaggttgcagtgagcagagattgcaccactgcactccagcctgggcaacagagcaagactccatctcaaaaaaaaaaaaaaaaaagaaagaaaagaaaaaagaaaacctacaaaacaatactaactatggtgtgtatatatatctgtatacacacagacacacatatgcatgcacacacatattaaataataaggacaacatacaggaataaaaactctccagtcctgagtgattattaacaggaggtagggctgaagaagatataaggaaaggaatgcagttagagaacacgtataatcgactttatactttattttctatgttgggtggtagtacaagtgtttattattttggtctcaagagctaatttaaaaaaagaaaataagaaggaataataactgtgcataaagtcctaatggctaaattgtggcactgaatagagtttgaagatcagagatacgtccactgagtaaaagtctccatatttctgctaaaccgcttagatgataattgcatttgttgacgaaagctatcaagcatattagaaatcttaaagaacgttctctacttcaactccctatagtagttttactctgaaatcacacttttgttgatttattgctgtttaaactgagtattaatatttttaacttcaatcgtaagttctttgagtatgagaatcatttcttcaacttttttgtgtgtctctcacagcatctggcaacatgttgggcatatgggaagcagttaaatgtttttgtttttggatgaatacaaatattcatgttgtgagaagactttacaatcagggccttttcctacattaaatgcctttgggtctactacttacataagtgtaggcggatatccaggtggttcaaagaatgggctttggggtcagaatgcctatgtttaaatcccatcttccccaccctgttacttgctacaaagaatttaatctttttgtttcgatttcctcctctatcaaaatggggacaatagtaattacctgacagggctgttgtggtgaaggttaaatgggatatacactttttagaaacttagaacaatgcctcacacatgtgaagtgctgagtataattgtcattaatattaatataattgcacctatcatactttgttccaattgtttgtctctctcttccatctttgctattagctctgttagagcaggaaactacatctgtcctgttcacctggctcagcttcagatacctagtagtcattgagtaaatgcaacttgagtgacagagtgagctataaagtttattctttggtgagctcaatttaaagtagaatttttgtgaccacagagaatcagcttgggccaatttttgtgatctctttctcaattagtagtagtgtttggattttgagtaaacagaggccactgctgcttacccattgcatagtttttaacccctcatgctttctgccatgttttatgggaaacataattaccagaaagagatttggattactcttgctttctggcattttggagaaaacaaaactatttagaagttttaaaatttggatcacctttatggttataggaatgcataagtacttagaactgatctttctataaaagggtaagtttggcccaaagagtgtcacccttgaatttttctgtctccccttactgtaatcagcatttatgacaatacagctttcccttcctagaggaaagatgaaacacaattaatatttcccagctccctttttgttttgctggttgctctttgaaatatctcattatcgttttgccttcaactgctggggaatgacatttgttacatatgaacatgatatgtatctccccaagttattgtaaattatgttcaccctctaaaatattttgtggaagcagataaacataagataaggtatgtgtaagccactgagtttgttcattcatttatttgtacatcattattcgtttattcagtcattcatgcatgcatgcatgcattcaacaagtatctattgaaagcttaccatgtgcttgtcttgtgtgagggggaaagatagaggccattatctcatggagcttataggccgcaggccaggggggaagatacatatatatagaactgactctctctctatatatatattgcagactatatctatatgtatattgcagactttgaggaatagctctgtaatggcatgtgatatgaatactaaaagaggcctatgctcttgaaaaagttttgcctgaggataacactttccagctgagatctgagtagatctagctatctgagggtggaaggaaaagtgttttaggaagaagaaacaacattcacaaatggacaattttaagaaattagaaggagatgaatgaatgaacagcagggggacgttatgccgaagaggtgagctcctgccaggtcatgtccaatctttccagccagttctatcctaagaacactggaaaagcattcaccagttgtaaacaggcctatgacatactcatgactacagccctggtaattatgtgaaaatacaatattaatagattggagaggaaaggtcttggtaagaaagagcctaagatacccgaaaggtaatttcttgggggtaaatattaacgggtttgccattgtctacctttaggctccaaacttatggagtacaagctaggtcttaggagcgtcttcttcttcagtactctaaaaaagctaaggagcaagactcagaattggatattccagcacgagactactgaataccttggggggtacaatgtctaataaatagtaaaagagagtttctgcccatgcagccagatgttagtctattacatgttctcagcagagtatgtctccccctccataggccttcatgtattctctttcaactgttcagaatatcttttctttctccccaacaatctgcctcccccttttttcccatctaatttcatctcctttgggtgaaaggtcacctgctttgatcaggtcagatcaaactgtaccttctaggaaaccaggaaaacttttccaactatcaaaactaaatataggttagatatccttgaggtaggctcatgtgccatccaatgcatctttatttttatttggtagcacttgtcattcagcgttgtgatatttggtctgtcctacgctgctaggctataggcctaattagggcaggaatttgtcttcttagtatcccttttgcctacatcaatttcctgtaagaatgcttagtaaacacttttacaattcagaatgaaaggaaatggggtaatgatactactgtgaacaccacgatcattctgtgaattgactgctttctatgattatgtaactctgaagaatgttatggtcattttataatggactgaaaacattgcagtgtttgtggtggttttgactttctttaagaaaatgttggccgcggggcggtggctcacgcccgtaatcccagcactttgggaggccgaggcgggcggatcacgaagtcaggagatcgagaccatcctggctaccacggtgaaaccccatctctactacaaatacaaaaaaaattagccgggcgtggtggcggggtgtagtcccagctcctcgggaggctgaggcaggagaatggcgtgaacccgggaggcggagcttgcagtgagccgagaccgcgccgctgcactccagcctgggctttgagcgagactccgtctcaaaaaaaaaataaaaataaaaaaaagaaaagaaaatgttatgaaagtcagtttctgacttggagcttaaagcagcagacaaaggggtcctttttctctgtcaaaatataagaagatcccaactaagacatttcattctagagataatgttaattctgtgtctgaaacatttgacgtagaataaaaggcagtttctaaaccgtgttcctgcctgttagtcctatgcactgggctaggttttcatgatcttcttttccacatctcctctctgttctctgacccagggactacgaacatttttccccctcactttttatagttaatgcgatatttggaaccacaacttctttaatctgttaactctccttacttgtctatattatgaacattgtatcacaaagatgactgcattacataatagaggaatatgtcgatatttacttattgtatataataatgtgtttatccataaagacaagatgaagtgttaaaggaagctccaaattaagattaagaaaaatgaaagagaattataatggttttggattgagtgagctcacataagaaaaaagtaatatacattataaacatttcttagacagtatttgaaagggaaatctgacttgataaaaatataatcatatttttaaccacctagttaacttatatttgttttattttattttttagaggcagggtcctaccctgtggcccaggctgcagtgcggtgatgtgagcatagctcactgcagcctcaacctcccgggctcccgtgattcccctgcctcagcctccccagtagctgggactataggtgtgcaccaccatggttggataatttgtttttttaaagtgtctgtaatggccaggtgtggtggctcacgcctgtaatcccagcactttgggaggccgaggtaggcggatcacctgaggttgggagttcgagaccagcctgaccaacatggagaaaccccgtctctgctaaaaatacaaaattaactgggcatggtgacacatgcctgtaatcctcgatacttgggaggctgaggcaggagaatcgcttgaatccgggaggcagaggttctagtgagctgagatcatgccattgcactccagcctggtcaacaagagcaaaactccatctcaaaaaaaaaaaaaaaagaaaagaaaaagagtagaaaatatttgtagtgatgaggactgtctatgttgcctaggctggtctcaaactcctggcctcaaaatgtgttttgattacaggcatgagccactgcctacagcccatatattttaaataaatgactaagagtagaatggggcaaatacaatacgatacaatggaaagagtattagatgaggcatttcagtccccataaggacacatcattgctagttattaagctttatatagtatattttataattaataaagcaaatctactataatgtgaaacgattttcttttctaactagtttaagatactggaggttcaaaatatttttacttccaatgagatccaaattttaaaaaataatcttaaaaccaccattagcaacaacaacttggctgggcttggtggctcacgcctgtaatcccagcactctgggaggccgaggtgggtggatcacctgaggtcaggaatttgacaccagcctggccaacatggtgaaaccaacccggtctccactaaaaatacaaaaactaactgggtgtggtggtgcatgcctgaaatcccagctactcgggaggctgaggcaggagaattgctcaaaccctggaggcagaagttgcagtgagctgagatcatgccactgcactctggcctgggcaaaagaacgagactccatctcaaaaaaaaaagagaaaatcatcaacaactcaactgccatcaaacaggaggaaggggaaaggaggagtgcgtttttaatgggcacagagtttcagtttgtggagatgaaaaagtcctggagatagctggtggccatggttacagaatgatgtgaatgtacctaatgccactgaactacagatttaaaaatgatcaaaatggcaaatttttcttttatattttaccccaataaatactgaaagcctactgacaggtgattgctgtgaggaggctatgtatgtgtatgcatctctcttaattcatttgacgagtccatttggactggctctgaggacttttttgtatattttaaaaattggtacaagttgatgttgacttatgttggtaacaattgtcacatgaaaaagcctgttttagacaaaaagtgaatggttatatgagtgtattctgctgcaaaatttccagaagaaaaagaaatcatgaatatttttaaaatttcctttccctctcatttccctcttttgctttatatgtgtggtgaaaaagaaagctatgaactgaggctgatttctgaagatgctgaagatactcataaaggaacagagtaggaaggaaaattagcttctaagatcagaacattaggcaagaaatcaacagacatgggttctaagacttacttggtgatttattagcccagtctctaggtgtccctgagcatccgtgttttttgttttttgttttcatcataaagtggggaaaattatgcttttcccatttgacttacaacgggttaatgtatgtaatcatgttttatagattgtaaagtgttctaaaaatttaaggtgacattattgtatctactggcactacaataaacaattgctttcactaatgatttccatggtataaaacgaatgaaggatctaaatgaggagcgttgctccgttctgtgttgattatatgccaggttatgtcagcctagggatgagttgaagcagagaggctgctacaatttggctttttgatttcccttatggtttctctctctcaatctgtgcactgagcaagcagctctctcaaaaacccttgaatacacattgatatatattccaaagagataggttttgagttatttgaactccagttatttttggacaaaattcatttgaaaagagaaaataataacaaatgattatacaagtaagaggactaaacattcatttatgagaaataaagtggaatgcagtaattgtgtttcctctaaatagctgcttttgtaatatttagagggtgatgtgcagcatgctactggcctgctttaaagaatgcatgtgaaatacaagctataatgcaagaaacgtatgctatggataatgaggatgtgagctatttttcattaaaggcagagagttacagttatgtctgtgtgtgtgtccttgtgtgtgtgtgtgcctctccgtgtgtgtgcttgtgtgtgtctttctgtccctctgtgtgtgtttctgtccctgtgtgtgtgtgtgctggctgatttggagatgaagacagaggcaaggatcctttctttctactctaggaaaggtttatgctccttgaaagagatactgtttattttcttgctataccttttgtgaagtattgagactcttggactgtgccctgtcactcagtaggctgaagtacaaatgctaattatcgccagactgcagcattgtgatttgcattccaaatcagcttgcagattcccattataaattgctatcctcttgtttcttatctaaaatttgttcctcccttacatcactcttctcattccctaacactgacctttaaagaaattccctttcaagagattctcattggaaaccagcagctttcgtgggctataatcataacaataaataacaaagacatcaatagggtttttccttccagtggttttctcccttttacttaagagtcatatggcactaagtaaaataattacttaaaacatgtatctctcaggcttagagctttatactcactcctttgacagccacgcttctatttctttttaaatctcaaaggtgtgggattacaagtcctgtcttagtaataaacttttgcagataaaccctgagatggtataactgcatcctttcttggcaccttaaatcaaattaactaaatacttagtgaggagagaaaaggaaaacacagtttttttgcaacgtatctgactgggtgagaagccactgctgcagcataaagaaccgacgggaatctgggctttcccactctggaatgaaggggggaattacgggttggtggtcggcttcatgttaggaggacacccctccatctgttcacagctcagcctgtttccaatttaaagcccagatttcaatacaaacctcaatttcttttccccattttaaatgcaaagcaagacttgtgaatcatagtgtctctgctcctgggattcagaccaaatttccccccaaaattctcaggctatttgtttgaatacctgcttacagtggtacacaatgggcagctttgagaagaaaaattgataatcttcacggaagagtaatttgaatgaaattacacttgacagcctgtctccaagcaaacaagaggaacgagggagcctgagctaagctctgaggacttgcccaagccactgctgttggagcttcccaggaaaaaaaaaaaaaaaaaaaaaaaaaaaaaaaaaaaaaaacccccagtttttccaacatctaattgagcttttgattaattccgtgtaccagattctactgaagaaaggtagccatggaagagaatatggaagagggacagacacaaaaaggtactgtgctaaaagcgtttatttgtaactaagtaattattttgcagtttccttgtttgctttagacacttgccagtaaggctaatgaatgtttctctcttggaaggcattttgttccttcctctcctttagtctgttcctcacttgcagtaatgtctggcacgaatgttgtcattatttgcaaatctttcagatataagtaccgaaatgcagagtcgagtattagtgagaagagcattgcggtattgtagtgaactattccttagaccagtctttgttaaccttcatttatttcgtgatttcacacttgccgagctgggtcaagggatccctagtgtgagccacaaatacaatatttggagttagttaaaaatttggtgatggaaccattatccatatctttgcatggacatctgatagaacaaagaccaagaccattaattatcttttgattggtgcacctttttaaaacaatctttaaaaaataaaaactaaaaacgaggatgcaatataggtttaagcagatggagcaaaagttcataaattttcagggtgtatggaagcgttaagattttcctttctatatagttgactgtaatcaacttctgagtaataatgttaaaggaaatttttttatgtgtttttaaagcttgtctaggtatatctggctgtatgagttaaagtgaaatttccatttttgaaggttgaaatggtcaaatattggtaatttggaatgattcaatcaactcgagaattgttttaacgtgtcaaatggtagcttcagagggagctagctttcaccccagataggcagcgtttctctcgtctgctgtcgggcttatgtaatgtcagagaaaatggtctcattttcttagtactgaagcagtaacacaggtaatactacataaaggtaatattcaagagtagtgttgaaaaagattcagctgtcaaagttaatttcaaatgtatataaaggcacttatcgtaaaaaactgtattttatgtgataaaatatatagggtggaagcacagtatagttaccatatttttagccatttagctatgctgggtttcttctcttaatgtacacacacatactttgaggcatatatggtgcatacacacacacacacacacgtaataaaggaccatcgatattaaatacatgaaggttttatataagcaagagataatagataagttgatttcccaattttagtccttagtacccttattcatgataatctgtaatagaaacacaaaaatctacattaatagcatgtgatctatttttaaattaaaaaacctcagctccctttattatatgcacaaatagcccaagttttcatcagtgattgtaaatgggacattttaatggtaatttctgttcttacaagacatctcagtggactattttaacttagaataaattaccttatgacaacatcttttttgtaatacctaataatgatacttattggccgatcaatttgcttaaggaaagataaacagcattttaaatagaggaatgatattcattacactaaataaaaccttgagttaaatcatggattgtggtaacaggttgaatgtgtctgagcaagccttggtagatgcgggaaccaagaaaaatgatgtaattagttgtgatgtttttttctcaggtaacactgaaaagctttcttttatgggggtggaggtggctatgccgtgaggggaagatttctgtcacagtgggtttttcctcattaatatatgcaccagcagcagtggtggaaagcagttttaaatcagaaaaaacgtttagtggtctatcagtttgtaaatgtatatgaatacaatatttatgatttaggtttttttcttaattgagaaaagaagatgtaattttcttcactcttgatcttctgttcctctcaattacgcctatgacaccttttctatataagtttgttgttagaaagttacatttgaatcgaaatgctctgtcgatatgtgcgtgggttgtaactgtgaaattactggaggagcaatttgacaagcagacaaaatcgttacagatttttcaagagtttaggtggagagacttaatgatctgtctaaagaaaagcagcattttgtgttagttcttatcctgtttttcttaaactgcataggattttcttaaacaataattcaaatagcacagagttttcttccatttgcaagaagtaagtggcttttcagtcttttcttaaaatttagaccttgtctttcctgttacatgtcaccaagacttaaaattcacatcagtgtttactcatatgaccttgcaaattcaactagaaggtaaaattcagtggattcattaattaattgcaatttgctatgttcgaaaatatatatacttggtgtttaagcatttaaaaagatcatccgtcttaagaaatatatttttcttcatagtgagagcccactcccctctcaagctttaaaagacaattgagaatagtcctaacttttatcctaatttaagcatatgtgttcagtcagagagagaggataatttaacagtatgggtgacttcacccaccagccattgtgttcaatgagcccatgcctgatgtgaaactgaaatggggatcattaatctgttgctccagcaatttctgacaccctccccaaaagtgagtatctcattatgctgaggggaatctagtattttaagaaacatattttttggtaaaacatggcctctaaatgaaagccacttacttcatcttgtgtgcagccaaaacaatgatattctagtatagaaaaaaaaaaaggaaaaaaagaaaagagtgttttgaatttggtctttactatggccataataaacctagcatcatctgtcaccaaaatcaagagccattgtcacaaaatcatggcaacaaggaccccagttactacagaggggttgagcaaagtgaataaagatattttgatgaagatttaacaggtaggcgtttatgacttgtagccatgcaactgtttctagaacattttgccaaatcttacgagaaaatacgtaaatgatttttgggtttctaattaggagtgaattggtgaatacacattcgggtggccagacaagtgggtgaccatctcttcatggacagccctaatgaaggccttgctgaattaggagggctttacagaggaaggctgatgaatcaataagtaaagggagcaacaaaactgtatagagataaaaagaaaacagcaagggacagaaagagccagcaggttggagtcttcataaattggctgaactgttccaaacagccaaaaccctgatggctttaatttctgaacatgaacattttatgaaacaggtctcaaaattacatggagtataccagaaagttttgatcagcacaaaagataacagccacagtgtcactcaccttatttttctagtgtaataaaccagcagcttatgtgagtctgtgctgtccatatcaaccactgacttttccaacaccaaagccccgcctgccatcgcctcagtggaatcaattcttggtgactctcagggactgggtcactagcagatgtagatgatcaagctgaatgtgatcaaatgaccagttccatcatttcaaacagcaatatacagccaaagttcaatggtcattgttcatccttagctcaatagcactaacctatttgtcatttcagcgtatctttaatttattaaaaccaacaagaatacataaatgaaaggagagggtacaggtttattttctttgtttttcatatcaatgttaatgttgatctatctcattatttaaaatactgtacaattattgttgacaagagaccccttcatcatatactttatacatttatacacacatattactataaaggaatctatgcacacaaggatatactgtatattgtacttaatataaagtatatttaatatacagtacagcttataggctgactaaaagtctcttcagacattttttgtgtgtgtaagattatttttatcttgaaagatgactctagaacctcacctttccttaagcagacatcatccctgaagaagagacaccactataatcaacgaaaaaaagaggcagctttggctgtaggagactaggaaatattggccaacctatactgcctggtgatttcagttccagacactggcctaaggactttacctaaatgaactcattggctcttcacaataaccttaagtggtactaatgttgaggaaaataaataccaaatagattaattgactagaccaaagtcacatcgtagtaaatagtagagctgggctcaatgcaatcagaatgagtccaggttctgaactttcaaccccactctctacactagatggccatagctgcctgcctggcagccacactccttcgaaggactgcctcccccacatgcttccattgcagtcatcagctatgatctgcaatttatggttgtgttccttaccaccaactctggcttcttttctttgccagatatgaaaactttttcaagggcagccaatctgtaagtgcactagcaatctacgacttgtaagtcgtgaattgaatccaaaaagatgaattggttcaattggccttctttcttgagaacggggaaaagatgactctcagtatgctctgaggatctctttatcccacggcaaattttaataataactatgctgccccatctttcagctactctgggtgaatctctattctttgcaatcgaaagacctctaagtaaaacaaatcttcagatccttttaggagtcttacataaagaggcttactgctaagaaattttccctgagtttaacctggtgagtcgaagctgaatcaactgtatatttaatgtattaaatttcaactttgacaccagtctttctttagtgtattcttgatgattttgatttttttccctcactgatctttgattttttacaatttaaataaattcgtccctaaatcattgcctaccagtaagtattggtagtataatatttggagaactattgcaaagaaattaaagagacagaatgtgtctggtttattaatagatttataatccttaatatgtcattgaagtctgtagactagtggctaagaaaataacaaaaacaacatcaaaaatctttaagcagtcatttaagtgtaagaattaataatttgcttcttagctgttggctactcacagacctatgaaaagggaactgattttatccatctagtggacagacttcgtctcagcaaatgctgtcacaaatcatctcttcagctgccatttctgcatttggataacaaggctaaaagaaacatagagaatcagattttataaagcatataggaaaaatctctcctaagatttcacagctgtgcttttactagcattgtgcttaacctgaagtgtcctcctgggcgtaagaaattacttttaccgcttggtattttcaaatgtagttctacaacatctgtcagtagggaaaattagttatatttttaataaagttcaatagatattcgtagaacttctgcattgttgtggttattatgtctgctgtggtttagatataacattttagaattttgtcattttatattttccttggatcagttgctaattatggtttcttttagtgtctgtggtactgtttatctcagagatccaaaatatcaataacacatttctaacatcttgttcagatgaaggatatgaatagatttttcacaatgtcattaaaatgagtgaattcaccttttcaaatgaaagtgcttgatatagttacttcattaattccttgaattaaagtttaaatatttaaagagactaaatgagaagtacagcgtgatagatagatagatattgatagtgtccttggagtgatggcttctaagacatgatttttagaaattaattattccttaattcatcagaagacaatggctcatgagagattcataggatacaggagataacttctagtttgtccattgcgaactccattttcccccaagcaaaaacccctcctcaccattcaaaatgtttgacagttttctttttcatacatcgaaggcagactgcctggcttactttcaaaaatccttttggatagcatccatactaacaggtggcacagctgtggattagctgacattataaaaataattcatgtttttccatgtgctttcaagttgtgaccattgtcttggatattcttaatccaacagtaacttacttctttgtactgtgaacaacataaagaaagaaaaacagaagataactgatttttttttcaaattgtgagtgggaaatataactttggtcaaagatgagactcagttccttattggagtctgtttatagagtttactagggaattaagttataatatgaggaaatctgaggtcagagaaaaaaggaagaatgactgtcggcttttaaatgatgtgtattaagagatgtcaacatgttagaacattaactgctgtatatatccagattgatttcccaaagaaagaaagacactttcttacattgtttcaattgtttaatgtttttggacttaaatttttatcatatgagaaatgatgagttttactttacttacctccatcaaagagaggaattggatgaaatctatccctgagaatgatgctagaaacataaaagagattgttcatattgtctcctaaaaggggatggtcatgctttttcttggttatcaagtaaaagtgaggcaattaaagtattttgctaattagcattcttcattgatttataatagaactttcaatgtctgggaaactattttctacatttttatggttgcaattaatattccccattagaaaggttatttgaatggtgaattacctattctttcttaacaaaaataaaatatgggagaaaaactttacacctgtatttattccgattgttgttttatgcaacaaagtttagttaataattcaaataaagaactagtacacggccaaattaccttccccccaaaacttgacagcttttttttttgaaaaaaaaattttttgagattcttctacacatttcctgtgttggtggatatccactttcattttgtttttgttttgttttgtttttgtttttttgagatggagtctcgctcatcgcccaggctggagtgcagtgggctatcttggctcactgcaagctcgacctcccaggttcacgccattctcctgcctcagcctcccgaatagctgggactacaggcgcccgccaccacacccagctaattttttgtgtttttagtagagacagcatttcactgtgttagccaggatggtctcgatctcctgacctcgtgatccgcccgcctctgcctcccaaagtgctgggattacaggcgtgagccaccgagcccggcccactttcatttttaacagcctataccatatcagtttttctgttcagtttcgttattgaacatcagaaacataattaagtacttttactagcatgatttatttgtcaaggaaaatattaataataatagctaatatttaataatccaggcactgttctaagcatttcatatgcagtgtctaatgtcaatatatcttaacactagttaataaatattgattacagctttttaataaatatcaaatgttctttgactttacggtcacactatttagtcaagggccattgggttcaaactctacaggaaactaagagaaaacctcacacaaacatccagagaaaaaaagaattgtcatgtaacaaaatgaggtagtcttccatttcagttccaagaaagattatgaggtgggcagaagggagaatgagccaaatgatttctccatttttctagttaaaaatttatttttcccacaataagggcatttaaattcaaatttttggaaccacagactgtacatttgagtggcagtaaggaattatatttatttttcttcaaacacctttcaatatttcaatattcaataatagaattcattattaaaataaggattgagcaatgtttgaacaatggaactcttagatatgacactgaatgtggtttgtcaatttaaaaccaaccataggctttgagaatctctgttttaaatagtaccaatgtattaccaaagccagattcatttagtggtttattgtctcagagacgttattttagtttttcatcaagttaaaaaaaaaaaccattttacagtgaaaagaatgctttgaatattagtcagaataattgaacttaaagcattttaaatctctgctcaacctttcacagtagaaagttgtaattgagtcataagatctagaattcagaaaccacccactcagattgtctccatgaattttaaatatgtataagggccaggagtttttcaattgaccatcataatgagtggccaattgacttttggtttcccaatcagatgacctgtgttaaagccctggctccttttctccaccttcattttctctgtaacttaatctgtgttattcaaccatatttttttcaaaatctccattttgagaattaattttctctaccattatctttgggtttaggtctgtttaatgtgagttagatgtaataaagactaggtaaaagcgcctattacaattcctggaacatactaggagttgagtaaatgcagattccttctccatgtttcctttcctctcatcttaacacactgtgcccatttaaaaaggtgaccaagcaattttccttgagtcagagagtcagaattaaaggactaataactttttcgaattgttgtaacagttatttcttaaatgtttgtcacttactatatggcatatcttactgttttttcttatgtatgtgttatgctgtagctccattctcaaagtacaaattcctgaagggtaaagtttttatcgtttgttcatgaacccaacctgcaaagtgctctgaatacaaacccattcatagctgatgatgatgatgatgatgatgatgatgatgatgatgatgaaacgagaacaggaggagaaagagaaggaagaggggaggggaagaaaaagaagaggataaagaggaagaagaagaggtcaattgtgcagactaaagaaagaataaaacacaatttttcccctaaatagagacagatctaacagagcagctaaacctggcttgggagaatgcagcaaggactccattttatgtcattagatttgaattaaaaataattcttttattctttgacctgaaatatattcagtagtttggtagcagctttcttgaaaatgaatagattttctttttttattattaaagagcccacacatatttttagcattgtgattctggcaatgaagtcaaatacattaaactgtcagattcagcaaatggttactgaaacttggaaaattatgtcataatattttataatacgctgttaaaatttaacaaagtagtttacaaatttgctgacactaggcttactgtgttcattcataagtattgatcaaagaaaacaaaattacataagaaataacagtttgaaatcattgaggacagtttaataagataagaccttttctaggatatgtttagtaatgttcaaggtaatgaatttaaaaaatagcatgcaatgagtaatcaattttcttttgccttcttttacgctttattttagtttttgtattttaattggtatatagtctcacacaattggcttatattttagatgggatcaagacagtatctgaaaacagggcatttgagctctggtcaatggtatcggaagagtatttccatctaacctttcaatgctcatcatattctctctacaattttggtgtactaagttttttgatgtattaatcactaatttgtgttttgagatgaacttgtgataccattatttggtggaattgagaatgaattcttgttaaacaactgaaataacttcatgttttataggccagttgtatagccaggctgaaaagtataatcttgaagaaagataagcttatttatttatgtgttacttttacatagtaacttttttttgcaacactgcacgaaaatttaattcacaaagagacagcaagcatgtatttccatgattgatctctacaacactgtttagcaactttgaaccccctccaaatgattgggatctgctcattatacttatacggagtgtagtatgcttaccaaaggtctaaaaggagctactgatttatgatacatgtggttctttcatatcatctgtgtatcaagagcgaccactattttacataaatatcaaaaatatttttgcccattgtttctgctaaattggaaggaaactttgtgtcatacttacagttatataatcattgcaatatttggccttaactctgctactctatcttcttttaaattctgcagtaatgcaaaagcaacaccactgtaacctaatgatgatgaggtcttttcaggcaactgtattacccatgcctgtgtccccccaggcattccatagtctttaaagtattaaaaaacatagtgtatttatttatctgacacgctcaatttttaaaaaatgtatcatatccactggtcatttcattccatctctaacaaattcctggaaaattctctcctattaactgacaaatgtattttgcttcagcctttaggtattaatagatttatttcttaaagtctactgagtggtctattacttatttgtctatattatagatatattagtttgaaccacgtcaaattaccaatattaaacactttttatctacaaaatggctattcaatatacctatattattacctattaattaatacctataatattaacatacctataatattaatgtgctacatttataaaagtttttaacgtgatcctgatttcaatgtacaaaatagaaatatatgatgtgaaataattaggatctgcatattatacttatgtggagtgtagtaaacttacccagcattctccaaaatccttgtgaggtcattaattcactgcttaattttccctgttagcaaaaaatggcaaactatttgaagactttattgtttgacacatttaaatttcatgaaaaagctaacattgatctcatttcttaggtttcttgagttcaatacttgggaggcttgttaaacatagtgctaagattaacaagtgtttaagacttaccctgcttgtcttaatgtagacagaatgtcctttaatcttgaaagtggaaaatttgctttgtttttccttagatagaataacactccaaaaatcattttccatacatgtggcatgactcaatggagtctcagagcctgcaagctgggaatgccattctgttatgagggggttctcttttagatcctctaggatgagtttacaaggctgttttgtggtccttaagggaaaaagagttatataccatttcagtattgaatgtaacccaggcattaacctgaccattattacctctctggtaattttgaagttttattttgcaagaaacagaagccttcattgaatgggttttatgatctgtgttttagaaatatgatgaagccatgatttaggcctcagagtggacaataatgcagtattatgtaggtatataattttagctattatttattaagtgttggtatgggaaacaagtggggatggctgggaaagaatttgatgcgcccgatcttactataggacagattaagttgttttagacaagatttggcctagaggttggagggtcttttctttggcttggataatttgcattcagtgaaattaaaatgatattgatattatctaaaatggacttatatacacagggttagcatacattgattaagtaaaacaatctatacctctacctagatttgggtatatgctatataattttgggttttttatattttgtatattcttttaagctatttatttttactttgcacattcttaaataagattgctcttcagtttagccctcaaccacaacattaagccctcaaccacaaattatacagttattggaattatttattgacttcctaaccactttggaatccatatactttttaaaaatattgtactctcaggatcattctatttgaaattacaattttgaaacatctttataattcagtattaaaaatcccatttaagggtccacaagttgaatgaaaaaagagataaacttcaaaaaatatctgaattgtatccttatcaatagtgttttatattaagcctcttgctcaaggatattctgtttgtttttgaaaacacttgcggctaacaaggtgaaaccccgtctctactaaaaatacaaaaaattagccgggcgcggtggcgggcgcctgtagtcccagctactggggaggctgaggcaggagaatggcgtgaacccgggaggcggagcttgcagtgagccgagattgcgccactgcagtccgcagtccggcctgggcgacagagcgagactccgtctcaaaaaaaaaaaaaagaaaacacttgctacttttagggtgacaaatgtagtcatttggagttgtctgttatacctcagtcttctccttgactccaatatttccatttttacttttgtacataaaaatagcaatactacttccgtgcctcatatgctttcactttcttgcactaatatcaatctctattcttataagttaagttagcaaaactgttcttcaattgactcttagattcctagatacttagattcaagcagttcttagtgtgagaggggaacattaaaaactatgagctcagtgcctctcgttttggaagaggtcattgaatgctactgccccacagtgagtcaaaatgagtggtccagagtcaaaaattaaagaactgcatgtattttttggccaaaaaggaaatgatgtatattatagaaagggttgatgcctgtgatactctaggaaaggcagctgactggagctccctaagacagatgagcaaagggagattgtgagtgctgcctaagacatcctggggcaggaaaacaagattggaagagctatttaaagccacgttgggaaagaacaatgttgtttcccattttgcaaaatgaaaaaaggaaaaaaggaaaggagagggtagactcgtatattttaagcactacgtatcaagccactgaaatctttgaactcattgctcataactagcctctggcaaggatttccaattgccttccttttgctttcatgtgcaatacagcagaggacatggcagacaaaaactgaatacctcttttggtgcaatataaaaaatgcattttacatttcccttggtaaaattgctttcctgaagtaatccaccgtattctaaggagaaaatgggacactaagaaataaatatctttacatttcaattgtgggttacatttgttctgaaaaagaatcgactcaggattaagagactaacagaaaagacatatttgagaacagtggtaacattcaaaacttacctatctgtgatagtcagtaaaagagttatgttgcctctccttccgccaccaagaaatataataattagaaagttagtacaaagtttgtatgtgtatttttgataatgtgattctggtaaatatgcaagacatgcaacataaatttaccacattgctcattgttaaatctaagttaagtgtctcaaattttcctcattccgtaacctagcttttcagttttgctctttaaatgaggcaattatgtaaaggaaatatttatttgtcttgaataactgaattgtaagtgtcataaacagagttttcttagccttaaataggtgaattgagtgcttttaggataatctgggtacatggtaatcttaacgtcaagtttaaataactcagcttcattaaaagttattaaatgatgtaacagcaacctttgtgaaaggtggggtgattatgggttagatcgttataaatgaataacttagaagagtgactattaactttactttgcaatgaatgtgttatgtttgtgatttgaggtttatttgtctttgtaagttacacaagtatagcggtaccatattctgagtagctcttcaacattagtttgctttagcaagcatcacctatttttgatgattacggcacttcatttccccaactcaagtttctgattcggtgagtatggagtggggcccaggaatctgcatttctagcactttctcaggtaattctatttttgtggatcctggaaccacacttagagtcttgtagattattggttaaaaaccctggtagctttcccaattgtgattcataatttatatatcaagataaagatattatggatttgaaatcccaaaatttgagaggaaataatattcagagattgcaatcatttaaaatgagaactttaagggtgttctggacaacaccgctataattttgcctttgaaaataaaaagaacttcgaagcctacaatcatgtacataagcccttgactacttcaaaaagtattgtaaaatgattgggaggatgtggtgggcagatcacttgaggctgggagttaaatgatatatagtctttaatctggattattcaataggcatagaagaaaattgcaatcatgggatgatgggggaaattgattgagatggcctacggttattgaaaatgctaatgcatgtaacaataaaacagttaccatgtattccatatacatgggagctcaattatttgagggcggggatacaaacattgatatcacatcacacatcattgctggtattaatactattgtcaatctcaacagctacctacccaaacatcattaataaataaattttatgaacaagattatgaaagccccaatgaacactaactcttaatattaatggttaaaatgttggttatcaatattgtgatggaataagatcatagagcatctttcatccacaaataaaatgaataaaatgaaagtaaaaagtataactatcagtatcccagctattaccatgtgctgttgaattatgtatttggtttctggcattatttggttcaattttacatgtgttagttatctaggagaactaaaatgactagcagcttctcatacattggtatggaatatgatattaaatttgccagtatttttttagagaagagaatccttagtaatctgagagaattgagtacttactaaaaacaacaaagaatggcataggattaacacacagaaaaaaaaacaattcaggacttatcagaaacgtctgaaaatactgttttgggtcagaacaattttaaaagcatgtttagacaggaaagaaattgtgaggtttaattcctgggggtagcactgagagaaaggcagtcttcaagctccttcattggtgcatgctgtttgcttctttgtttttgaactaatgaatatataatgagttcccataggaattaaacttcacaacttcttccagaattcccagatgtaaatatcactcctaaattataatccaaatttggtaaaacaacataaaagtattgtgaatgcaatcaaatagggtgagtggtttgtattttagcttttacatacttataatgaaaaacactaaagtaccagagggaaggtagtgtaaataaacagaagcattcaaacataaatgtatattctaactctgctatatactggttgtgtttttaggcaggtgacttaacttctgatcaagagacttaattttctcatccatcaagtaggaagaaaagtatctatatgttggaattgttgagatatttagaaatcattgaatgcactgattggtaaattagagatgataaaaacagatttttattcatctttaagattatattattatcttcattgatcatgttatatcgcctccttgtccatgctaaaagccatttacttccaatgtttgtgattatatgtaacataaatataactcttattgataaaagataagtagataataagtttagagtgactagttgctagccattcttctaagtgtcactgtgcaaggcagactacattataaagcttttgatgtagaagtggtggagacagagagcaactaaaacagcatccaaacatagataaatagatatttgagaaaatatcagtgatagagtttgagaaaaacagggtggcctgttagaaagtgacaagattgcaattaagctgttagttacagctgcagtctcatatgaaggttcagttggggtggggggagtaatctgcttagtggctcactcaagtgatgctgcaggcctggtcctgtaccacatgaacctctccacagggctgcctcatgccatggtgcctggcttctccagagcaaaggatctaaggtagatggggagagagattccatgtaagttggaagccacggtacttttacttattttattttatcatatttcattttattttgagacagggtcttgctctgtcactcaagctggagtaaagtaatgattatgactcactgcagcctcaaactcctgggctcaagtgatcctcccacctctgcctcctcccagctgggaccacaggtgtgtcccaccatgcccagctaacttttaaaaagtttttgtagagatagggtctcagtatgttgtgcagactgttctcaaactcctggtctcaagcaatcctccctccttggccaccgaaaatgttgagattataggcatgaaccaccatgcccagcccacagtgcttttataatgtaatcttggaaggaacatttccttgcttctgccatattctattcattagaagcaagtcaaaaagtgcagcccttactcaggtggagcagatttcagaaagacatgaatgctactcggaagggattattgagtgccttcgaagaggctgcctgcctcagatagccataggtacctcaaatgcaatatgtccaaaatggaatttatcaactgactgttgaatcaactctacatccttggttcttgacttccatcacatctgtcatcatttatgtacactgtgtcccaagctagaagtttacaggtcattactaatgcctttcacactttcctctatatttaatgggttatcaaatgctttcacttcagaaatgtctcctaattccagattctcatcttcaggtactcagtaatgtaatcgactatttccttaagctattgaggttgtctttattatgcttctcttcatccaatttctattcgctttaattagaataatttctctcaaacaaaatatattcatggattctgttgcgtaaaggcttccattgtttctactgcctataaaattaaatccattagctttattttggcatatcaagcccttataatatggcccaaagcaaagtttctaggcctactacccaatcttatcattcagcattgaaatagtctctcagcatgccctcacgtgatgtgtacaggcccaccctgatttattttccatcttctttcttaccgaccatgcctcaatcagtgcttcattaggaagctttttccaggcttccatattcatcataagtcatgcaattccccaggttccagtacatttctataatgacatgcagctccttgaattatcagcttcattttttctatttctatgctatgcttttagaataacttccgagcaatattaatcttgaattcaaagttgtgaacagaatagtataatgattgacaataaatactgagtgaataaacaattccttgtttaagttattgtgtgtaattgcactgtatctttgaaaggaaatatttaaactacagaagatccaaagaagggctatgaacaagtaaacatttgattatggtttctattaaggactcacatgtgtaaatctaaagaaattatatgaatatttaacacttgttgagataacatcatttgctaagcactgtttcaagtgcattatatttattaatttgcataatcctcacaataactatacaaataagatacttttattactcttattttatggatgaagatgctaagacccagagatttttgataatttttccaaggtcactcagcagtaagtggtgaagttgcttcttaggcctgtcaatgtagatccagatactctgtattactctagaaggaaaatggtttccaaagatgcatccaaatcaagatgacataaattgacaaaggttaaaaagtaaaatgaatccaaatcaagatgacataaattgacaaaggttaaaaagtaaaatgagcaaagactaaaagtcaaaagactaattaggataaatggatgaaattatatttgtgaaccaagaggatcagaattgacaatatcataaaaaagtattttaaaatattttccctctaaataccaggaagaattttggcagcttaccagagtttaaagaggaaaagaactcctattatcataaacaatgggaaatgcatttctggaagtcaagacatcagatgatccaagtaaaaagtataagtagtgtctgatgtgcagaagaattcatggatcttggccgggtacagtggttcacacttgtaatcccagcaatttgggaggccgaggcaggcgaatcaactgaggtcaggagtttgagaccagcctggccaacatagcgaaaccctttctctaatagaaatacaaaattagctggttgtggtggtgcatgcctatattcccagctactcaggaggccgaggcaggagaatcacttgaacctgggaggcagaggttgcagtgagccgagatcgcgccactgcactccagcctgagggacagagcgaaacaccatctctaaataaataaataaataaataaataaatagaatagaatagaatacatggatctcttacagactattccagaatgttcttaattgctgtgaggtagggacggtgggtatccaggcaacctccaccaacagggtcctggatagctcagagtaagagcattcatattgtatgaagccatagaacatctttcagaagggcagttattattaattttttggaggagttctatcaaaaatacataatatagtccataatagtaggctcatctgtactagctaaagaatgtattagcatggataactttttaagatacaatggtaaatgaaaaacctgggaccacaagcacagaccaccatgcctggctgatttttgtattgtttatagaaatggggtttcaccatgttggccagggtggtctgaaactcctggccttaagtgatctgcccgcctcagcctcctaaagtgctgggattacaggcatgcgtcaccatggtcggccacattgtcaactttatcattgcttgttatattatttgttttatgtttgaaaggtttcttaatataaatatttaaaagtaaaagcattatgaatacaataacatgagaatcccatatgtatttctgtctttaatttcaatatttccttggaaattggcaaataaactttctgatcagatgtcaaagaattataagttaaattccaaaataaagagttttacattgtattttaaaatataaacttattaagcaaaatggaatttaacatctcaaattttactaatattcatcaattataattatcagtggatgtattctaagtaaacttagttgttattttgaaaaataacgccattctcaattttatagagtatctttacaagaaagcatgcatttcccaagtccattaaaaataaatgtattaccagggcagtaaaaaaaatatagggttgcctcttctttttggctattttcttcatttaattattttctagttttattttttacttttaaaagtacttggaagagtagacaccaaatatccactgtaaaactttagaataaaataaaaatggtataacccatgctgtgagcttaatactttctacacatttgacttaactttttattggcatggcagtttcaatccaatgcataaccagaagaaataaacacgatatgttactagcagtaaacagagggattaaacatatgagcttaaaattttttagcacatatgagttggaaattaaagagactgaaatatatttttataatgagatcaaattacttaaaccagagtcaataactgttatactgtaaacaaatacaatcatttatttgtagctttataaattcttttatgtcaatgctaattttactgatgactgtttagggcttatgaggactgctcaggttatatgattaataactaaatatgaccacaggttgtggtatcaaagcatcaatttgatttaaaaaataggctccccataaatattttaataaatggaagtatttctgggagtgtagaaggacaatatgtcaattttcagaaggcataaaagccacaaaatatttggaaactagtttgctcatgttacagaaaagtgtgtgtctgtgtgtgcgtgtgtgtgtgaataaatgggtaaaatatgaatgtctctattttgtaataaatattgcttctgtatgttttagatgagtgctttcattctgatacaatcattttgttagtagtctccatctattaagtaagagaaaattgaatctcttctctgttatgtggatgaagatgatgactgcagtcaatttctgagttcaattttaaatatgcaaatttaaccttttataaattgctcttactttacatatagggacatttataacaatacatccaacagtctacaaattaatgtcaaataatgaagcaagctccaaattgtgtgactgccaccagttgactgggtggcatatggcaagtcacttaacctctgagaccttaattttcctatttgcaatgctaaggagtggtgctagagttccatgtctatgcttctactaattttagatgcatttcttaaaactgatatcttcaagagtaatgtaaaaacattattaaattcttgtcatcttgctagaacaagaatatcttttctatctatacattttatttatctctacttgttttaataaagcccatctgccatctgatttatttattaaataaactcatctgagaatcaattttattttacctaatagatagagcctatgcataacatgattataaattgtgaaaaaaatggaactctagtccaaaagacataggaaaaggattggccagaaaataggtacattcatattgtatttattatttctttttttctttattctctctctctcatacacacaaccactccccattaaagcaaactttaattgtaaatatagtaaatacccaagtgaagctaaaacattttgtatgttatatatctaaaggattagtttaaatatttgtttcaacctagtgctaacatttatgctctctttttttcctccctaaaagaacgaacaaaatattttttaggcaatgaatagataatttcatcatgttgcaaagtcctttaattcatggcatttgccgttcttggttttcaaatgaagactttttaaaacaataacgaaaaggatatacaactttccctatgccttcataaatttccattgtacaatataaaattaaaatcgtgttgagatagagtgacttccattttggagaatatggtatccttatatcatgtacaccccggtgtcatttgattttgtagtgaaagagaagctaaaatatattgacttcaggcatttttgatagaaaatacactcataaagataacagtaactaaggcagaggataaaaagaatcatacttgtgatacttaatagcattttagtattttaaaaactgatggtgatcttactgcaagcatctctacagggcagtctcaggaaatctcattaatgtgttagcccctttattttgctggtgaatttgttgacagaaagtaattgggtcactgtattgaaatgccccatgtaagctcagaattctctgtgttggttggcatgacaaccatagtggtcgattaaacatgctcagaaattgggaacctgggcttctcagaagctgttaactagatggggaataaaaaactgtgtagataatggcaaattgggcagaaatttctaagaattgccttgaatgtgctattacacatttatttatgtagtgctaacaagataaatgtatgtgtaaaaagctagatatttaaaaattcacttagatgattacgaaatacggttttgatttgatgtgtatttcaataagaaaaggttgaaacagccttacagtattaaggatgttattagagataattctgatattactcagaacaaatatatttgctatcaatggcaatttctatttagctctttctccttgtaaatgattttgtgaggtgcctggcagatgatatccgcagatggcatacaaaggcacattggcacacaggaacagcctttgctggccagttctgccatagccaaatttagggagcaggaagatggtaaaacgacaaatcattaaggagagaaatagagagttggtttgatggtatcactcactaatatcttttttcttctatattttaactcccttcctttggccggtagataactgttaacataaagacaaaatttggagatagaaaattaaagcaagttatcatgtcctaggacacaattcatgttttttttgttattcatgttccctgatttctcatacctcagaagacatttagcctaggagaaggaattgactttctaggaagtattattttttaaagtcagcctgcttttatcaggataataaaataataaaaacaagataaattgaacataatggatttacagcttctgcaatgagtttagttgccaagacaatcaacatgtgagatcaatgaaggggacatgttttaattttattatttcttattagtgtgctgatattaaaattcaaacatggatgttttgattaatcaagaagctgaatatggatatcaactataaaaataaatattttaaatagaacacatttattccaaaagtctattgttgaaataaattttaaaaatcattattcattatagcacttttaaaaagaagacgtattaaatatcatctttgttctgcaaaagtaaattaactttgtaagattaggaactaattagtgatagaactgggcctaaaaccctgctggcctcattcaaatgcagactctttttacagcaccatggtgtcttctaatcccactaccaagtacactgtggtcaaaacacgttaacttcctacttccaggagatgttcatttagtgtaaatgaaaccagcagtgtttcattttcatattcctcattttctttctttatcataattccttgtatggagctatggctctaatttattacattatgaaccagtttttgtttgcttaaatttttagatagccttattaatgtcttcattctatttatatgtctgatttgttcattaagaactattaaagggtggataggtttaagtatttgcccatcattggctggtattttaaaatttacttccgaaacaaaatccacttctgaaattcccctgtaacactatagatgcatgattctgtaaaattttcattttctgctatgcaaataattaacagtaataaaatctagtttcagtttagtttataactgtctcttacattaaattttctaggtttggggataagggttttgtctgtgttgtatttgcatctgtatgatgctttgattgctttgattaaagcttttcaagtattgggattcaaaactgttatttaaaaaaaatcagtagtctgtatatttctacttttatttctattaataaaacagactgaatataccttgccaatttaaagaaatttctttgagaaacaactgactgttttccttgatttcaggattgaaaatacatgtatctcttactgttccttttgtttttcttgacatatcagttaaaaatctttgctttcatcctcctttgtttattctttaaatctattttcagacgtttctccttttcctttctgttgtttggtctcttctctgtcttgctcttccctattcagacacatcctctctctcccctttccatttgccttgactagactaacacatattaatgaatatccacaaagggacaaaaagaggctggaggagcagggtgaggtggagaagcgaggtgctagcaaaatcaaatctgaaataaaggatgagaagagtgtagatggaaaaaatggggaagaaaagatgaaacaatggaaaagtgtaattttcataacttaaaacttcaaagtatatatgtatgacttttttcgtcttcatgagattgatttgttcattcattcaacatttaataaatatataacaagcacccagtgtgggccagctgtagtcaaattgctgggaagatagcaattaaaaacaagctaacaagccaaaaccagccttcatggagcctatattctgtaaggtaaagctgtcattttaaaatggtgctttatattgcttgtgaatattcttgtttcagaagtgagagcaaaaggaacagatttttcaaagaaaattatgtcttgcatatattaaatttgtctgactaggaagagttatgtcagtaaagcaattagatacatgggttgtgatttggggaaaaaagctgaattagaaatctgtacttgtaaatcatcaacaagtatgtaatcattggtgatgttgatactgatgaaatcaacctaaaggtggaacaaaaaggaccaaaaatagtgacttaaaaaaacaatttagaaaaaatctcagaacacgaaacagaatgttaaattgtcacaggagagagcttatgcccttgaatcaagggaaaatagagttcacaaggagccagcggccggcagcatcacacttttatgacagacctggaaggtaaggtcaagggtgactttggtgggagtattatcagtgaaactattgaggaaatcatttctgctttatctctgtagtgcatgcctcattaaatacattattaaagctttaagatgaattttattaattggcatgtcacatccaatgaaaaggatgctagttttttgtgttgtttgatctttcataaggatttgaacagtcatatgtatcaagggtaaaaaacaaaaacaacaacaaaaaaaagaacagagggagaaatagaaaaacaaaggaaaacaaacaaacaccgagattataggctaaaggaaaattcacagagggaggtcaattgggggagggaatgccgtccagcaagtggctggaaaggttaataaacactttcaaagaagaccacagatatttttctttctctttaaagaataaagtttagccttgttcctcgaactcaaagaaagaaagtttgggtaagtctcattttgtgtgtgctcggttttacacttctgttggagaaagaattgtggtgaaattagtctggaggttttgtgcagaatggattagagagtgagactggaggtggatgatgatagaggccagaccaagggaaaagccatagaatgaaagggtgcaactgactcaagggaacatggacaagaagaactgataaggcacacatatcatattagttctgagggagaagggaacgtctagactcaagctgctttcatgtgcttgagtgataaagagaatagagaaacaggaatggcaggagaaggtgctgggtaaaggaaaaaatgtcttattttagacattttgagtttgaagtgacattaagacaccatatggggatgaaaatagacaatcagaagtgagggactgaaataagtagagagggcaaaggttcagcacgggagctttgtagatgcccaaattgatgtaattggagggaggagagtcaggaaaagggagagaagaagggtaatttggatcaaatgctacctgccaactgaatactgctattcatttttcaaaaaaaaaaaaacaaaacaaaaaacctttcctgaccttcaaaaaagatggtgttatttgtaagtgtctctacctgagattttaaacattctcaattcatggtgtttgtagtgtcccagtaatttctcctcatggtgtctccaagtcaaaagaaacacctagcacttttaagttaatggatgtcactgtgttttctgttgaaagtttaaaatatccagcaatatcctgtgagtttgctgccactctgtgagatgccttgggtcacagcttggaaactataggtttatgcgatgctctctcatatttttttttcttttttctctatcgaagtgtttatggcactctattataattgcttctgtaattatctgtctttctgattggactgagtctgcaaactacacaaggaaagaaccatttccatcttgttcctcattgaatccgccttgcccagccatggtgattggcttgtggcacgtgttctgtaactagctgttgaattaatcccagttatgaggggagtaatcttatttgtctttatatacagtgctgatttatctgcatctatttttcaaaccctagattattttctggcatatgtcttttagtagaattattctaatgatctatgtgaaatctgttgacaacatatgagtagtatgaatgcaaatgctaaaaaaggggtttcttctttagttctgcctaagaggggaaagggtttaaaagaataatcagtttgggtaactgttaagggtgatttagaggagatgagaataataactataacaatagttaatgttaatataatgtggttactaattctattctcccaacagctgtaggaggcatgatgcataacaaaataccacaaagttagtagcttaagacattaatttattatttttcacagttatgtgggttgtctgattcattcttctgttctatgtgatgctggctgcaagatgctgggacatctgcagtctcctcagagcttgattgggctggaatgtctaagagggctcaattgatgctgggtgatggctgtgagcttagctgagactccgcgccagaattcccaggtgtggcctctgcgtggaatttgaacttttcatagcatggcgattggacttggtcaggggacatccccagagcaagtgatcttagagattaaggcaacagtcgcaaggtttcttatgatctagcttcggaaatgggagaaattcacttctgttacattgtacttgcaaagccaagtcactcaagctagcccagcttcaaggagggggaattagattctatgtttccatgtaataggcagcatgcacatacagaaaggggatgaattgagatctttgactattaccaaatgtaggtactattacttttcttactaggattgaggcaattgatttatacagaggctattaacttaatttgatagtggataagtgcaatggccagtactagtacttagagaatttgctcccaagagtttgtgtctttaatcacaaccaagtattgcctcagcctctagcaatactgttcattctcatatatgattacacaaacacacacacacacatacacacacacacttagcatatttagaggtcatgatgctaatgatgatattgactataatcatcataatttgtttttgacgagttcattataattcacattcattattttatttactcatgagatgaatttctccttcaattgtttaattttgaaataattttacatttacaaaagcattgcaaagatagtacagaaacttggattatacacttaaaccagcttcctctgaatgtttacataaccatcatacattaatcaaaattaatacattaacatagatataataatctccaattaactacagactttacttggatttgctaatgttacctactaattatctgctaatgtcacttaatgttctaggatacaatccaagaaactattgttgcgttagtttcctacaagctgtgacagtgtttccatatttctttgttttacatgacctgacacttttgaagaatactagtcatgtattttgtagaattgccctcattttgtgtttgtctgatattctctcatgattagaatgggattatagatttgggggaagactaggacaaaagtgatgtgcctctctcatcacttcatatccagaagcacatattatccaccttatttattactgggaatattaatattgatcacttggctaaggtgttttctactaggttacttcactttgaagttactatttttcccgtttcaaactatgtatgttaaaaaagtgagacattctgtctatactatacttttaaagagaggtgataagctccacttcctagaagaagggatatcaaaaaatttgtggacatatgttaatactaccattgtaattggtagatatttcagagagatactctgaggctatgcaaatagaatgattctcataaaatgaatttgagtctttatttttctcctctgatttgaagtttttgttgcaaaatttatttttctatttttttgtctgtaaatattgtgatataatgtgacaaaattgaaatccataaaatattgccaataattcttatcaatctatataaattcaaatacaatccatttcccaattaaagtataaaacatttaaatgagacaattcatttattccatttactagctctgccttaaggaattgaatcaaagtatgcattcattttatttaattatatcaaagcatataatttggcacaaataaataataggctttaatattatgctttgaaaattttgcattgttttaagttgtatgttaagctcctttcatattatttaacttggtattccacaaatactgaatttcctcactaatttaatttatgaaatattgaagtcaaaaggattaaaagaatttctgatgaaaatggagaaaaatataacatcatgaataattcacaattgttctattcctttatccattatttttaaaaaaattattggcaaaattaatgtgacttaataggaaacaaattctattagagttaagtttcttatgtagatgaaaatagggtgacaaggcagtgcctgattatttaataatttatgtttatgtttagaatccttactattatgacaaaggcaaaaaattttttaaattacttttttaaaaaagttaattcaaaacatttctcattttgataaataaaacaaggtcacaagcaaattaaataaactgtcattaaactagaacattttgaaaataatttaatagcattactttatgagttttgctccatcattgctaataacttacaacaataaattttttttcagatttctagtacagatatggatattaccatgtctgtgttaattttactcagtgtattgacaacaaaatcttaaatatttattttaaaatgatggtatataaagagtattttagtagttcaaacggtaacatcgtgtattaaagaaagaaatgagaataattattttcactacttaattttgacatttatttattaataagttctatttcttaagctatgtccaataaataaggtaatttatactacttatggaatgtaagtagtttaaatgtataaggtagtaacaacttatctgtaatttccatgacttgtgtttctactagttaatcggatgtaataaactgacataaactggagagtatagctgcatttgagttttattaatttgccgcattgtattaaaaaggaccatcaagaaaacaatgatgaacaaagtattatttccatctttgaaaaacatattagagatatgtaaggggaggaagacatgacatagcacctttaccttacagggctgggtataatttcctttgtattctttcagttgagattttagagagattctgcataagggtgacttttttgtaggaaccttcaaggatgattaagattttgaagggtgaaagtagatgacgtgatattccataatgaaaaatagccccagcaaaagcctaggtgggtgagggaaaaaaatcgttgagaaacacagagatattctccttgtttatcctagagtatatggaagaatggtctgtgaaataaaattggggttagataatgggaaaattttagcctaaactttttagagtttagcagaaaactgataataataacaatgctgtgattattatagccagcacttacagagccttaccatgattcagtcttgcaagaatccaatgagatagacaccattattatttttacattttatggttgagaaacctgaggtttcaagatattttaggactcaccctttctgctcatgatcactgtgctagatgacctttgaatctttatgaaaatgtgttatattataaaaccacgctttaaaaagggatccagaaatgtatactggaggaaatatttgtggtaactgaatattataatgaaggtctcatgagtatacattcaaaggtaaacttttagacaggacatttgcacaggacattggcacaggagagtcatcccaatggccatgttatatagcacacccaaagttccacagcctttagaaatgtgaaataaatctcaaatgaatgatcaagattgtgaacttttaaaatgtgaataatctgcatagagacactagttaaaggtttcaagtgcaggaaatcagaggcaaaaagaaagcattgaggtaatgaccgaatgaagtgaatgcccatagttagaaggcaaaggaaggaaaagagcaaaagtatcagagaactgtatggaagatcacttggtgctgtgaagtagaagttcaaaaaggaaggggttttaggaagcttgacatggttgaagttgagagggaatttcagatccagaagtagggatgtcattaatgatacatgaaatctgtttccttctctggctgcctcttttttggtcaatgctacaacagaagagctctgggcgcccctccctgacacccccttcccttcatttcttcagggcatccaaacagaccacctgggattcctcagtccgcttgggcctctgatagaagcatttgtgtgcttgtatgatcttattttcgcacggtgggtgttgtttgagtcgtgttattaaaaccaaagaaattaatgtgaacgttatcttttttgttctattttttttttattactgtgcctgaggccctttgctgcatttataggctgcttttattcatctctgagttatttggtcttgttggtgatgaactatgtatttcatttcctgcctctcctgataccttgcccttctaattgatggatcatatactttctaaggctcctaaattcctccaccacaagtttatcttttctacaccttttatcatttaacctgactaatctgagtagacagaattcaggatttggcttaatcctaccattaggaagtttctatattcatccaataaaatataatattattatagatgggtgatcacaaattcacttattttggagatagagaacacactggggactgattgttaaattagttttcttgcttctctaaagcactgtagtgtccagatattttaggtattattcagaaaacactggctaatttgtgtagtggaaattcaaattgtcataaacattaagatacattttaaaataagttacatggttattgagacacatgaaatcattaagcgaaaactataaaataggtaaatataggtttgaatatgcatgtgttgaatgtgacgcactgtgttatgctatttaagtctctccataactgcatgatagccgttcatgaattccacagatatttattgagtgtctactctgtgccaagcacttgggatgaacagaagagacagaaaactgtgctcttgtacagatgcacttccttttgcagagcaagaaatcagaagttcatgcaagtgatttattaaaagttgatgcctgggcctggcatagtggctcatgcctgtaatcccagcactttgagaggccgaggcaggtggatcacctgaggtcaggagttccagaccagcctggccaatatggaaaaaccccatctgtactaaaaatacaaaaatcagctgggcgtgggggcaggcacatgtaatcccagctacttgggaggctgaggcaagagaatcccttgaacctgggaggcggaggttgcagtgagccgagatcacgccacgccacttcactccagcctgggcaacagagcaagactccatttcaaaaaaaaaaaaaagttaacacatgaattaaaatactaattttttctgactttaaactatttttttttcactgagcatactgctacctccgagttactgtaaattattatagttatattacccttttcaaaatgaatacatgtgtattatcttctctggacaaagtcattcttttcataaagcacattaattttgaacttatagttattattctcttatctccttttaaaattttaccctcatatttccttactcaggatatatgtagtgctaaccttttagctaacaatcacgctaccaacaggtgggtgtatctgttgccaaagggaaaaactaagtgcagatatgttaatttttattgtgcttcatagaaaagttttttgttattattatttttaatttgttaactgaccttcagtgtttgcctctagggatgcgtggagcagactgtccctaattttgcttggtgatagtagaacatattcttgagagccatgagacctgaaaagctgtggtagaacagtaccaagaaggcaaacacatgttcatgttgccccatacgaaacccgcttactgaactggaaaccacatgaatgctattcattacactcaatattcaatattgacaatatagcctaagttcttctgtgaaatataacgtgctttggaaaagaatgacgtaaatctgcgttgattgaggaggatgtctagtatacattataaagctgaaacaaaacggaaattgctctaggcgtgcatgagagttttaaaatatttttattggtcagatgatattcataaagacttccacatcaaatgggtaacgattgcatcaagcagggtgagatttaaacaggcactatggtgagaaactgcagtgctcacaggatagataaagaacaagagtgggtgaggcagaataaagaaagcatggagccactctctcatcatttccataagcatttctgggaactggatagcttactagcaattattcttttttttctggaatatcattttgtaatacatattttacctcaattaccaacaaatgttatacaataaatttgtaaaaaattagtaaattttattccaactgtataattgatatatatacttatgtattatacttatatgtataattatatagtaattcacaagctatcaatatgtgattatattattgatatatccatatattacaattacataatatgtaatgttttattgtatataataatgttattttatatatttagtagatatacatgttattaaggagataaagtcattaggtaattatagtcatctatgtcataggcagtagaaaaatttgaggcatctttaataaggaaaaaactatgttgtttgagttttcttctatcctacagagttttctttttctttttctttttttttttttttttttttttgttggatacagagtcttgctctgttgccaggctggagtgcagtgctgcgatctcccctcactgcaacctccacctcccaggttcaagcgattctcctgcctcagcctcccaagtagctgggactacaggtgcacgccaccacgcccagctaatttttgtatttttagtagagacggggcttcaccttgttggccaggatggtttcaatctcttgaccttgtgatctgcctgcctcagcctcccaaagtgggaggcatgagccaccgcacctaggccccctacagagttttctttgtcatcatggacctgggctattagatgaatgccagtgacagaaaccaaacttgaattttaaatagtagtacccaactctattaatatcagtctaatatttgtagcctaaatctaaatgcttcagccttccttaggataatttttcccacagaaaacattaatcccataagaaaacagaattctggtgggcccaacctagtggtcttcaagttctactctggtattttttaataagcattgtagagagtcggagttgggaaatggtgaaaggtaagcagattacatgcaaatctgtgctccattatgctgtgaaataaatgagtgataaattctaaaaaagtagtttgcagagtttctgctctatgaatagcaagtggactaattaaaaacattactttaaatgtcaaactgttctttatggtttgatatgtaaatgttatcaaagaaaaataattcctatcatataatctgagggattaaaaaaattttttattagttattttttacaattgaataaattcctatggtcttcataacctatagataacatattgggcacattgttgatttctaataacattgaagagaagtttgaaaattatagtttctcaaattcatttatgctaatttaatatcctgttagtaaattaattatgtttaggatttggtgtgttttgatattttctagttaaaaatcaactgcattactaattataaaatataaaggctaatcccatatcttataagtagatataacacattcatttgtggactcttgtagagaatatttttatcttttttttactaagttaataaagaagagaatgttctctatctcacaattacatgttatatgaagagataactgcatgtttagtataaattaatattaaaaatattctaccatttgttgagtaccttacaataggataaggactaagatatgtaatttttttactgtctactctgtattataataataataaatagataataataaacaggtgtgccaaggttctgaaaggctgagtgctatttttcatgaagacagtaaataaaacctatgatctttattatctctagttaatatgtcaggaccttgctcacaatggtcctatagctagttattgccagaactgggattcaaaacaccaaattattctcctccaaagcctatgtacgtttgcataacaacagtatacctcactatcttgcatttactatcttccctactacaatcttcctttacacatgcatccttaataattatttcaatggtctaaaattaaatttggaatttataaatgtctgttattaaaatacgtgcacacacccatgtgtgtataaaatgtttgtttctttgctttttgcaaagattgtattttctttatacagggcttgctgttggactttgatttgcatacgtaggccttgacactatgagatttggagacttacctcactattggtttcgtcatttcaatgtatatgaatttattttccctttgttcccaggaactccacttattttatatacctcttcctttgtatatattaaagtgtaacagggtgtttcaaaaatcatggtgggggttcgataaataatgtgtaagtgtgaaattgaataataacatttagtagggacattaaaacgtcgctaggaaaaacgtatgaaactaaatattatttaagtagggattcttactttgcctgttcatgaaactgatttcccggggcagcttcttcgttgttgctaacccttgtcatgcttccaagatcaatggttgaatatattagagactgaacaagttaaaatatgctcagagatcccttgcacacctgacttttttggcagcagctcgagttttgacatcatgaatcagcacagtttgctctttcagtgtgagcttctgtccctccttcctgattccgttcctcacgtcaaggttgtggccaggcctttgtttggaagccaagtggcaagatgcatttgctcttactgtcagttacatgaaaaaggcacattaacctaattttccatagaatttacatataaattgacttaacacagggggtaagtcagttaaaaatgggagacatttaggatagactcagtataatattgaattgaaatttttctctaagaaagttttattaagggtcttgccatagatctctttttgaaaaagtctttgctcatcgatgtgttatctcttttattgtccctttaaaaaaatctggtttcaagttcttgcaatttttatggaaattctcacaccacaaattaatagtgatgtcaggtatattgtgtccttggctttttataatcgaaggttttccagaatttagtgtcttttgaaatttttattttttttctcaaggtttcctgtttcatattctagtcaacacagaataaaatataacctccccttttgtgctttcattccattgggctgatttatagattataacttggatttccgcagcatgttgattcaaggtggtagagaaaaatggctctgctgtaataaacatttaattggcttatctgaaaagagtagactatttttggagtatatttatatgacttgctttatattaatttgtggacttgtttataccaccagaaattttcctgatttcttccttttaatggttttgacaattaataggtagtcctttaagggaatatgaaagcaaggcatttggaaggaagctgccatttttcccttctgctccatcaaatttgccatttttttttacttgattttgaaatgcaaaataactaatagtggataggtaaggattaaaaattattagcagaatgaaacaacatttgagttaatggaaaaatctagggtttttagtgaaattctgaatatatatgctaaacaacattcctcacatccattttgttgggcatgactttggagaaacaccactatagaaacgttctttttatatcttcaaaacagagaaaacactttgtcctttcccatttgcgtctttcagcactacaaaatatctgggatcttcatcagatctgtgttttataccggactgagtctagattttttaattttctgaaattttattaggttaaaattgtttatttgatacggagatattgctctcaactgcaaacattttggagatgcttcttctatatagccttgcagtgttctagagcaattctaaatacttccaaagatttctgcctaaatttacactgatatggttgtgaaccttctaagccatggtagactttacacgctaaaaataaaaatgttagcactacatacatctgttcaccttatatcctgatattattgtacatccatattgactaatattttggtcaaaattttgggatcgtctggtttatttagaaacaaaaattattttatggaaattctttaaaaacaatgaatggacacacaaaatgtttaagaatttttttatatagcatcagtattatgaactgagagatagaaaataactgttttgcataagtttttatagtgatttgttaagctttcccaggaaaaatgtccttcattagacagccatgactgagtttttaactgattaattgtagtttaatgatgtaatgttgacattaacatgtattctttgctctgttgttcaattgtgacaaggatcttaccattatatacaagactcttcattgaataaaatatttgtgaaattcatgacttattttatctaataaactcagtggctgattgtttttagtttctcttaagaatgtatgtattgttggattctatgccaaaataaaatattggaagttttttgtaaaacagaggtgagtttgattgttttattattttactgagttaaattaatatcctcatacttcaacgttagtattaaagattagaggggagaggaatctaatgacttacagtatttgaaggatttagattttatacaaataagattaatatgcttattaatgtttttaaataattagcaggatgagttacattagatatgatgttattaatccaagagttaattactgagcattttagagacctttggttcggaagaaagaaacaaaaaataaattcaaatacaaatttccttccactggacttgatacacattaaagtatcactggacttgatagacacttcatacttttactgaacaaacatctaaggtaaaaacagcaatattaacagaacagtggtctatgaaacttgattgaccttaatggacactagagaactgggattttgaattttcctgatgaatctcaagctgtcttgggtaaaaaaacttgatagaactgggttttatgaatttgatatgttgattaatgaaatagaattttatttactcttccatttaatttatttggaaggatgtattttttaatatttatgaaatggtatatcattttggtttgacaatttgtgtattgaaaattttcctttctatttttaaaaacagtctttgttcttaagactttgcatatactgaaatgagagctcgggcaagccttttgtctggagatgcctatagcttctacactagctattgctgtgtttctatggaaactgtgcaggactctgaggtatacaggttttatgtacagtgatagccaatccttttctctccccattcaaattgttaacatataattgtgcttctgttatttactaaagaatacaaataaaatttcattactttctctcacaagtgtgctaatatatacatgtcattttgtatcaaagtagtattatttagcattattcttattatttttaaagagtttgataaatagaaaatcaatatttatcttgagaatcatccttttttagctctgattgagatatttctttaagtttgaatgttgagattttatttctttttcaatttcaaccaatctatgccaattaggttttcttattttctgtttttactgtaaagatgcaacagtgaattctggaaataatttcagagctaagcatgtgatcgtttaaggctttgagtatataagaatagagatttttctccactgaatcctgaatggcatatgccgatcttactccatgacaggtcaatgtgattttagtaattaagaagcctcacatatagaaaattgttcttctgaaaaaccattcaactgttttttaatatgcactgcagcctgtcaacattaggctgggaaacttatgtaaactgatgttggatatttataagggtagaaggaatcaccaccaaaacatcattggatgaggtttttcaaaatgaagattacacaaattgaaagggattggttaattaaataatcataaaaggcttttagtatgctgatttattccaatggccctggccaagacctaaggtgaattattgaccaagggggtccagaggaaattttaaatgctttgggttttaagcatgttactttatattgattggacttgccctgcttccatttgatttctaaatactagatgattaaggtttttactctgtaatgagtatctttctctctctgtctctctttgtattttggtgtaaaaaatgtaggtagaaaaagtatggaagcccatggatgattgtaataaatagagacaaggaagatggatgctgaacccaagagaatgtggaaagtgagactagagtgttcagtgtgatgtctctgcctttccttttaatttttttttcctctttcctccagagggagtggatagaagccagttaggaagacctgaggctcaaaactcagcagaatgacaggaaggaaggtttcccagtctaaaaagggataatgtgaaaattggggtagtctcaagctccttcttctgtgatctatttgtgacatttctggatgaaacactggtaacataggatgcgacagagctctttgtcagtgatacactcttgcaagcatgcgacattcttctctcacattgctcttcatcctcctaaccccctaggacttcagcctttcctgaggcttttactctaaccaaagcctctttcaaagtggcatgttctcgggattcattctctttccaatttcaaaatgctatttactggaggataaaaataggagcagtatcctatttgaaattactgataataaattgtgattgacagatagactggcctcatattaaggtgtttgtgggacagaataaatctatttacaataagaaggtgtgtaggaaacattcctaagatacccttatccttccccttgtgactgacctgggaggatcagcaaatgcgcactgagcaggagaatgatggaaggggcaattcctagaaatgcacaggagaaaatgacaggaccaagggtcagaaataagtctgttggcctctcgtatcaagaaaaattaattcagattactgacaagcaaaataaaattctatactaaagcaaggaaggtatggttttcacagagatttagtcagtggatttgatcagactatggcaaggcaaagcagcccattgattgagaagaataaaagcagggatcctgcctgctttgttcaccacccattgcacatcatttgctcgctccatgcctgatgcagtaataaacatttctgaattaatgaataaataaaatgagccatctatctggctagttgtgaggtaatcattggcattttacttttgttttatctgaattttatttggatcttaactggattttttatgcttttattctgttttacgtcttctaaacatcaaatataatgtttatgaaaattctttttttttttttttttttgagacagagtctcactctgtcgcccaggctggagtgcaatgcagcctctgcctcccaggttcaagtgattctcccgcctcagcctcctcagtagctgggacacaggcgagtgccaccatgcctggctaatttttgtatttttagtagagacagggtttcgccatgttggccaggaaggtctcaatctcttgacctcatgatccccctgtctcggcctcccaaaagtcctgggattacaggcaacagccaccgcgcctggccatgaaaattcttaaaactgaaagtgaaagcatggaacgcactaaaacagctgaagcagtgggagtgacaaaatccaattagaatgtgccagagattatatgttcatattgcagggttggtaatgggcaaaaaaacaaggaagcaggagctaggacactgtggccataatgaaggtgagataggttaggatagagaaaatatttcctaaaataccccattcttcccgctacagacatacagaggaacgaagaggcattacatatttgtgacaggtaacttcaaaaaccttgatattttcaataagtacttttcttgttatctgttttattctcagaaggtgcaggaagccgctctcagattaataccagtaaataagggatgcaccgaggatgaagtaatcatgttggcagaaatcggctaggttgttgtgagtgatctcttctgggaagcctgtgtagagatagtaaaaacagtccacacaggtaccatcgaagtatatctggatattatggccgattaaccagtagaaagatgttagagatgctgctgaggaaattgcacagtgaggtcatccatgaggcagcaagatcagggctggcagggatgttggaattcagtcttcagagactggacccacatgggaaaattttgaaaaggaaagttgcacaaatatagcacatgtgcaatgctgaaggaagataacttgaagtagaacaaacagaagaaagtgtgagagagaaggctggacagtcaagcaacgggcagatcaaaatggaagttataagcctgaaattcattctgaggcataaaaagcctctctgaaaatgtattactaacacgaattatatggtaaagttagcattttggaaatgtcattctggctgacaagagatgtaattaagagctaagagattaaaggtgagccagcctggcagccacagagctgttaaaagaatctaggcatcggccaggcgcagtggctcacgcctgtaaccccagcactttgggaggccaaggtgggtggatcatctgaggtcaggagttcgagaccaacctggccaacatggtgaaaccctgtctctactaagtacaaaaaactagctgggcgtggtggcacatgcctgtaatatcagctacttgggaggctgaggcaggagaattgcttgaacctgggaggcagaggttgcagtgagctgagattgcactccagcctgggcaacaagagggaaaactccatctcaaaaaacaaaacaaaacaaaaaactgggtatctcttatacaatactgtaactaaaagtcattataataggtcaaacgtgcaaaaataatgatattattcaccttgctattctacttcctgaatattttagtggaatgtcacataggaatagaatttagccatttgatgagactgctaatcaattgagactatctatgattagtcttaactttattccatgttttaatattttctggacattaacttttccaatggaacaaaagctaagaaatatataatggaatgaaagcagttagcaggcaagtttagcatttactgtgagggtagtaagacatagacagaaagaaataagatgtgggaatatatcatttatttggtagatagtagactcttgagtatcattctggctcctctcgcaatctaatggtgtaaaagttggctggcatacaaccctgggttcctaagcctggcagagacctcattcgggggtgtttggatcagtgaccatggagcacatatgagtcacaggggggccctgggcaaaaaggtccattgatttgtttccctgaactcacctggatattttgcacaaagtatttgctaatctgattcctcattttctcccaacttcaaacccagataggcctttgtgtttaaatcaattatacatcctagaattgtttctgggcatttttttcatttaataatatagagtaaggtaaattaggcctgttttctcaatggggcttagaaagattatgtggtttatccatattcacattgctactcatttgaaatctttcattgaaaagtcaagatttaaacccaaggttgtttgaactaatatgcaaccatggttaataaactacctttcaattgacattttattattgagggtgaaaatagatattcctaaaaactaagtttcagatagtacctatttatttatttatttagagacagagtctcactctgctgcccaggctggagtgcagtggtagaatctcggctctctgcaacctccacctcccgggttcaagccattctcctgcctcagcctcctgaatagctgggattacaggcgcccaccaccacgcccagctaattttggtatttttgtagagatggagtttcaccttgttggccaggctggtcttgaactcctgacctcaagtgatccacccacctcggcctcccaaactgctgagattacagatgtgagccaccgtacccggccaggatagtaccttattttctaatcttgcactacacattaatgtctatatttatctttaaatatttatgttcagaatgatacatagtgccagatagttcaattcaactttggtgatacatgtgaagtatagcctattatataataaaaactaaaaatgcataaactactcttataaggagcaaatgaactttctaggcaatgcatcattttttcctttttttaacttaaccttcactatttctcctcatcttgcttgagttagtcactatactgaattattattaattttttagtttttattctcttttctgtttgctctaacaatccctaagctcccaagaaacaccttgaatctccccaacaagctacgtcattttcccgtatttgcaataaatggcatccaagacatcttctatggaaagaatttattctttcagtgaaagaaatgtagatggcataatctgtctaatcagtgacacaaaactgatatatttccttcttagaatgcttcgcactctcttatacaatattcacagtctaaaactagagttttaaaaaaatcccttggaacatttcatataatttccctatcttaatcaggtgaaagctttttcttagaattttagttgtcaaattgagcatcatcatgttgtaattaagtagtaattcaaaatcagaggtaattaaaacaaattcttcccctttctagataaacatgaaccatattgttcttaatagaagttccaattttgttgtgttttctcctcagttttaggggtgaactactatctgttttgataaatgctaaactaaatgcagcagcctctaaatctctgaaaaatatgttatctgcttgaatctcccaagcaggcaacctgatttttcagtgtaggtatctgaaatatgtggcatctaagacatcttctatataaagaatttatagtttctcccagtgccagaaacctggaggccttgggatgttctagagtgaaaccacccactcaacatccgcattataactctgaattcatgggtgacaatcctgtgtctgctgaacatatttaaggaaattcaaactttctagctagtaatggaatgcagacaggagaaaaaatgtttataaaactcctaaaatgcattactgcccaatggctgaagccataactacagccacatattttattagatggtgcacaattggtgtgtagttacttttattaaaagtctcctaaaaaaagtgaaatgtgaaaaaactttcctctaaaaaaatctgttttctaaaacatgctggatttctggttaaaacactagacgaagaattcatcaaggatttctcgaggttttcatggtaaagctgcccagtcaggggtttctgaatttggcaaagatttgctgtacatagtgcaatcacattttctttggccaggttacaagcagttttcatgtatagagaaatcatcttcctgtcccccacaggagtgtcaccttctcacaacatatgtagctctactctgccaaaaatggggcagattttgaatcttggctttcaagagctattccatctgtggctcatgatcttttctataaactctctaacttctttgaaaagaatagtatgtatcttcaggagaactgatgtgcccactgaatatttaaacaggactgatagcttttatttcaggaaaatgcgctagactcattaataataaaatggaagaagtgaaagagcagtagtccttacgttttactgcataccctttcatgtcctgaaaggcaatggctgaaacaatggattggctcattaactgccgaaaaagtttatgattagaggggaaactcagaggtaaagagtaagtggaggccaggcgtgctggcttacacctgaaaacccagcactttaggaggccgaggcaggcagatcatctgaggtcaggagttcaagaccagcctggccaacatggtgaaaccctgttcctactaaaaatgcaaaaattagccgggcatggtggcagtcacctgtaattccagctactcgggaggatgaggcaggagaattgcttgaacctgggaggtggaggttgcagtgagcagagatcacgccactgcactccagcctgggtgacagagtgagactctgtctcaaaaaaaaaaaaaaaaaaagagtaagtggaggcactgatcttctaacacatcattagacaatgtgctctgcagagagcactgcatcaatgataggtatattagatcaatctaaatccattttatttataagttaatatatcaaaggcaatcaggcacaacaacaaaagcaaaatgaagctagtgatcaaaacttaactgactagtgtaaattgaaattgctttaattggaatcactcatttaatctggattgacatttcttcaggttttttcctccagataaaggcttattttactgagcgaatgttttcctaacatgattagagctgctgcatttcagaatcacttacctttctaacccttttgtgttcttcatctataaaacttaagggataaaataaagttgatttaattactagtcctaattttagtattttatgaaaattttaattacatgaactattctagagatcaaagaataacattgacttaagtgccatatgaactttctacttaaacgaagaatatttatctcttactgtgaaaatccccactgggcttacagtctcatgtaggaccgagtagttatactaataagcaggcccaaacaatgcagaataatgaatcataaagaatcaaattatttcagttcatttcaaaggacaccctaatgttggggcaccctgatttgtattggaaggtgatttggagaatatgatgtatgaatagaggcctgaacaatgagcaggacgttgttaaacggagaatggttaggtgtgtgtggaggacacacacacattaagacagcatttgagaaggttctagaacagtgtggtgccgataagatgtgaaaaaggttgatttcactggggcaatatgaaaagagagccaggaagtgaatttggggagcaagtctgagatcagatcatacagagactaataggtcatagcgaggattgggtttttattttaatagtagcaggaagtctctaaaagatttgaaacaaagaggtgacatatgggtataaaaatactgctagattgaagaaataaattctaatatttaataggacagtagggaaattatagttaacaattatttattacatatttacgatgtttagaagagaagacttgtaatgttgtcaaaacaaagaaaagagaaatgtttgaggcgatggatatcctaattatcttgatttgatctttacaggtcatatccacatatcaaaatatcacatgtactcacaaaatacatacaactacaatatatcaataaaaataaattcttaagagattccctccactgtttttggtggagaataaacttaagatggtcaaggcaagaaggaagagtccaagtaaaatggtggtttggtctagtgcaatgccagtgataataaagaaaagtgggagaggtcaagctgtttgcatatgatttgaagatggactttacattggtagggaggaaaggagtgtgctaagaatggctaccaggcagccaggtgcagtggctcaagcctgtaatcccaacactttgtgggggccgaggtgggtggatcacctgaggtcaggagttcgagaccagcctggccaacatagaaaaaacacatctctgctaaaaatacaaaaattagctgggcatggtggtgtgcacctgtaatcccagctattcgggaggctgaggcaggagaatcacttgaacccgggaggcagagtttgcggtgagctgagatggcgccattgcactccagcctgggcaataagagtgaaactctgtatcaaaataataataataataataataataataataataataataatgcctttgggttgagtcactagaatggagctataggagaaggttaaagaaaaatttaatatggatgtgcaaataaaataattcagtctggggcatattaagtttgagatgtataccagatatcccaatcaatatgtcaaggaggtagttggctatcaattctgatgtttttattatgtttttgaaacagtgagtttcatagttcattgaggatatacattttatctttggatatgaaggatgagttctatactggaaaggtattggtcctgtttagaatgaaaacagttttccccaaatcttgtattcttattttcttaatttttatttggaaaagaagcctatcacatgacatacgttatctagaaaagcaagccaaatgtactgctaaaatcatagccacaaagtagaaacaaaccaaatgtccatcacctgatgaatgaataaacaaaatgtggtatatccatacaatggaataacattcaagcataagaaagaatgaagtactgatacatgctacaacatggataaatcttgaaaacgttttgctaaattaaagaagtcaggcataaaagcatgtgtgtagcatgattccctttatataaaatactcgggataggcaaatccttagagataaagcagatgagtcactggtaggtgctctagggaggcaggaactgaggcaggactgcttaatggatacaaaattttcttttgggatgatgaaaacgttctggaattagatagtggtgatggttatataacatcatgaatgcaccaattatattgaattgtacacttcaaaatggtgaactttgtgtctgtgtattttacctcagtacaaaagggaccaaaaaatattttatttgatcttgttacttattgactaaaacaacatttccaaaatcatgtttctgataactgcataaaaagtactcagaaaataagtctgataacagtaactgcagaacttcacaaagatgttattatgatctattaatatcagcagtagtttaggatttaaaacattgaaaatttttcactggagaataaaagcaaatttaaattaaattatgttatttggatatatagaagactgtttttttaaaaaagcctgttttctgatagtagatctaattccataagaaatcactgttattagtttattactgggacacgtacaatgttctattccatattgttaagtaaagagcctactattaaataatctggggttattctttatcattgcatttttccctagataaactgcatttaatgaggacctattacataaaagaatttgacctatcaataaggggaaaataaaattaattttcattggtccttaagtgggtttatgcttatttaaaacctcaaaattttagtaaattagtcaaaggaatctgattcataaaaataatattaccattaaaagacaaaatacttgatggtaatcacaggatggaaactaattttatgagttcattgatgttcatccagaagggaaagattggcttttaaaaatgcatttctgggccaggcacagtggctcatgcctgtaatcccagcactttgggaggccgaggcaggtgaatcacaaggtcaggagttcgagaccagcctggccaatatggtgaaactacatctttactaaaaatataaaaatctgaaatacttttcaaaaataaaaataattgaaaatgtattgaaaagtagttattgttaatgaaaaaactagcagcatctattttttaacaactttatagatatatattttacatataacattcacccaattaatgtgtacaattcagtggtttttagaacacaggcagcattgtgaaaccattaccacaatctaattttagaacatttttattactccagagaaaaacctcctacctattagcagtcattcctcatttcccttccctctctcccagtcccgcgcaaccacgagtcaatctagtttctgtctctatagattggctgcatctactttaatccattttgtttcttatttctgtttttcttagtgtctgaattagacactcaccctgggggttgtggggaaagaaaaagcaatcatctgcactggcccttgagacatgcattttcacgtgtggccaattgcacagatgcgcatatgttcttgttttgttttgtttacccactgggaatcactttcccataattttttttaatcgaatgcctttttataacattcatgaataatattttatctgtctagaagtgaatacttagattcggacatttaaatcctttgtctgctgtcttttattgatttcagtcagagtttaaatacatttcatactaaacatagcaatactcgataaaagactagcaagctgatgctaaatatagtgaatttacccctatggcttcaatatttgacgtattgtgaatgttagtgctagtctaaatgttgttgggtgaatgaatgaaagaataaataaatgagtgaataaaaatgtggcaaacatgttgtatgagcaatagagcaatatattattaataccaattatagatgttcttggctgaatttcttttgtgtttgttgataatattaagtggcatccctgcactatattaaaaacttagcaaactgtcataaaatgcatactaagtgtcaagtaagcgtagaatgaccaagggaattcaaagcacattagacgaggacacttgcatctgaagaactcctaatctttttcagacattgaaagcttattatggcccagtgcagtggctctcgcctataatcccagcactttgggaagccgaggtggctggattacctgaggtcaagagttcgagaccagcctgacccatatagtgaaacctcatttctactaaaaatacaaaattaggcaggtttggtggtgcatgcctgtaatcgtaactacttggaaggctgaggcaggagaattgcttgaacctgggaggcaaaggttggagtgagccgtgatcatgccattgcattccagcctgggcaacaagagtgaaactcaatctcaaaaaaaaaaaaagtttattatttggctggtgagaaactgttgatgttatttatcatgttcctagactagaaatggtcaattaatttagattttatgatttttatttttatttttttgtcaatggagagacattactcaggtgttttattactttaaaaaaccttttagtatattattaattattaaattatagatgtccaaataattatatcctacattttaaatctgttacttaactatttaattgcggcaaaatagattaaatacaattgtgggtcaatgtctatttgaaatattggtagaaggacacctgctgtattttatagcattaggttatagtaacattgtgacatcattcaacacatatttatggagatcatattgtatgcagcagtgtagcgattagaatttttgcactaggctgggcccggtggctcatgcctgtaatcccagcactttgggaggctgaggcgggtagatcatgaggtaaggagtttgagaccagcctggccaacatggtgaaaccctgtctctactaaaaatacaaaaacaggcagacatggtggtgtgaggtaggagaatcacttgaacccaggaggcagaggttgcagtgaactccagcctgggagacagagcaagatccatcttgaaaacaaaaatttttgcgctaaagcaagtactcacttctagctcagtgtagatcttgactagtgactctgagactgtgtcattgcttctcaaagtgatacataactttctccctcagtaactctgggataagaacagcacttcccttagaagtttttatgagaattacataaaacaataaataaaaaggccttaataccaggcttagtataaaatacaatttcaataattgttagctgttattctaatgtcacagtcattctgtggtcatcaagatgttttttgattgtctattattactgtttatatttcagatgtacccagacaaacatttctcattctaagagtcctattttctgttgttttatccttaagcaggaagatctcggtgtatatctctgtatctatttctctctctctctctctacctgcatccatttaatgactgaataattcactactcagggagctctagttttataaatattccctatggttttcagtttatatgaagagtatttattcttttcccatgattttcatgtaatttataatcatcattggaatcttgatttaatctttataatctgcatttgaatatatcttaaacctctaaaacatatttcctcaacatgagagtcttttgagcatatattcataaaatgtcctagagttttataatgtgaagagctataagagataaaaatagtcccccaaggttgttgtgttgcttgtctcctcatcttttctcagatgccttcttatacatcttatacacctgcttcttatacatcttatacacctgcttcttcattttgaatttcacaaatatttatttccataaacacctacctattcttgggaatcacttgggaactgtcaaaaattcagaagtacacacatggatcaatttgattggaggagaaagcgttttagatgtatttatttagatttattttattttattattttattattatttttgttgagacggagtctcactctgctacccaggctggagtatagcggagtgatctccgctcactgcaacctccacctcccagtagcgattctcttgcctcagcctccagagtagccgtgattacaggcatgcaccatcacacccggctaatttttgtatttttagtagagactggatttcaccatgttggccaggctggtctctaaatcctgacctcaggtgatctgcctgtctcggcttcccaaagtgctaggattacatgcgtgagccactgcacccagccagatttagattaaaacataacattcttgtattctttctggtaatagtctataaaagataatctctttcttatgaaggagaaaattgctatatcccctcattaatacataattcctcatattttagagattaaatttttactataaagtgatacataatcatggtaaaatttcaaaagctatgggatggtataaaaacaaattaacagtcccaatttagcccttcacaaaccccagtgttcatttctgggataaccaccattcatagatttgtatcttcctctacattttcaattcaaatacatgatatgagtttaaactcataatctatcattaaataaactgaattgcttgttggagttgcataggttgattgccagcataggtttggaagtcttttttaaggaaaaggaaaagacccttgaaattcataacaaaaattatttagcaagctatgtacaaaagggagaaaaagggtaaagaaaattttatgccttttacagtttaacctcttattgtcttgatatttgatttttaatgctaagttgtcttgaagaattatctacgtataattgaaatcactattttctcttgccccccccgtattcctcaaacccctgtttagtttggtttccctttatcaaaatcacaaaaccatcatcatgaggcagataaccacttatgaaaaacccatacagctacacacagcaaataactggacactgtattcagacactaacagtgagatttgcggtctcagaaatgccttcaagagcatctgtaacctgacttgctggcactcaatggacacttaatagtttttgaatggctgattgcatgaactaaagatttaattttgcacaatattgttttttagaatagtataactgtgtgctgcatgctagacactgaaaacagctgaggtctcaaggagagtagattctagcaatttttgtgacttcattttgccacaaaatggaagaggctgtctgccttgcataaattagcatgaatttggaaataaaacttgatgttgcaatcccttttaaaaacaaaattgaaagctgaccgcctcctgggcactggaggtaaactgcatgttcagtgtgtgattttgtatcccctgctgtgcctcagtagaggacagcaggatgtagtcagcatcttgtatttatttttatgtactaggactttcctactgttacaaccccaggaacaatcttggaaaaacattctttgtttctgtaaatctaaataaattttctcaatgttccttttagcatctataaaaaacggtcatttttagatttaatttgctatttactcactggtggatcaattgacactctctgccagtgtctcctaaataacactccacatttaggcagtgcattacagttagaaagctattttacatacataatcatatgcttggaattggtgaagccaacagatttaattgaatctggctaaacttacgactttcatcatatcacttgctattccttattgatgtcttaaaagttgttatccattttcgtaaaaatgctactgttgagaaagcaaaataccttgattttcttatggcactttatattttttccaatttttaaaaaagaaatggaataaacaagagaatatattgcttactaagcatttttttgtcccagccctgtgttgtatgttttaaaataagtaatacaaatgttaattcttacagtaactcttacagatgactctggttaatttaggaaacagagatttggagaggttcaatgggttactttggatcactccctggggaagtgaagggccacaactggcagaggcctttcctactccaggaactgaacttcttccattgtgtgatggcacttacttctccattcttctgctttggttgtaaatgttaggttacataacatatttacaattatgtcactgcagttttattttatcatgatattaggcttttaacctacttttaattccatttcttggctaatctgttcaaacatgttattatctgtacatttttatacttattcgggttctatgaatggttctttgttcagtcaaccaagtgttacccttcttccttcttggatacagggctgctccctctctttggtctcgtggtaatgctttctaatgagcatatgattctctcagatactcttctcattacatgtctttttccttgaactttaaaattaagtcttaaaaaccaatttacccaatctctgattgtgtacatgatgggttgttacattccttgctaagaaatacactttatgttgagaacattcattttgaacctagtctttgctaaaagcactagtggaactatgtatattccccatttgagtaactgatcatgattgtgcttgttagttacttatccaggcgtaatacattttagtgacataaagcaacaacgaacatttttatatcccacgattactgtgggccgggaatttgggagtggcttggctagacggttctgaattggggtccttaatgagactgaaataaaatgtgaatggtggctgtagtcataggcagttctggcagggttggagcatccacttccaaggtgattcattcacctgctcatggctggtgctggctctcagggggagtcctcagtttctctccatgtgtgtgtttagacgggaatgcctgtgcctcctcatagcttcgctctgacttctcctagggtgactgaagcagcactcccctgtataacctggcctcaggaggggcacactgtcacctctgtcacatccaattggtcacacagataacacctaatgcaatgctggaggagactatctaagggcatgaataccccaagcatccctgggagtcatcgtggagactagctgctacacattcccagaggtagcctccagttcgccttcttaaacccacccattgccccatatttgccttcattacctagctcctctttcttcataagataactaatattctctttatccccagagttgccttgtctgcttacgatctcaatttactttgagatgtcagtattttatcaaaggggcaattgattttacttgtccttctattgcttatcacctagagtatttttaatactaattcgaagtgcatgactattaatgattgcatatattatttagtgtgtttattccaccgtgtacaggtgttttataagttcatatacctagttctgagatcttcttctagattacacatcattctgcccattagatatgtctgcttttacgtcccagtgacagctcaaatttatgtctgtctgtgcttttccttctactggctccatgtcctatcctgtcaaacccaatgaatggttccaccataccttagtctcataaacaaagtactgtcagtaatttggagttcttttcttccctcacacacaacatgaaaccagccagactgtttcatggagtctaacttttaaaacctttcaagattgccatatattctgcctcgccattgctacagccataactcaactcttgtcattcctttactgaactgtgttgctaatctctatgttttcaccattctttccatcactccatcagaaacccatccttcagagagcttccagagcattcttcccaaaatgcaagtgtgagcatatgcctcctatgcttaggatccttcagtggctccttactaccttgcaacataaccctactctctcttctttccttaagtcttaccactccctccaccaccacacctaacaccttccagaacatgctagatcttaatcacctaaataacttgaaattcctaacacatcagaccttagctcctatagtgatatgatcagccttgaaatcttctctcctcctcttctttcttacctactgaacagcaactaatttttcaaggctcaatacaaagcttgccttttttggtttgcctttctgtcttcagttttctctcctcatagtctgcaggtcttgtgatgtcaatgactatgacttactctttccaaatctcctgagatcgttgtagtcactgacacacagaagccatcaagtaaaatgctgatgaatggaaatagaaattcattcatttgacctaggtaggtggattacatgaatatttgactcatccaggaacactacataattacctacaacacaggttgtgtgtgaatgctattcccaggcaattgtctgttgggcttgcagagaagtaagtactaccaacgtaattggaggaaacttttttatgcaattttgaaatagaagcaaatttatactttctttaccactagattgaagttttacattaaggaaaatgagttagtttttcttatttcctatttaatgtgttagaacataaataaacatttcagataccctgaaccttaattcttgaaaatattattattgattgcatgattacagagattcattttagaattgaaaaatctcttttgcttcttgaaagctataaggtaaattttatgtttagtctttctgactgcatttgaaaccttaaaatgttaattctgtagcattcatgtaattacagagaagaaaatagaagttattttaggtatagctaaggataccatatttgtttattttttttcatttaagacatcttttagtacagttatcacattgtcaaccagaaatgccacattgtttctacattattattattctcttttttcttctgtaacaacaaccagttgtatttccttgggtctgtatgttgttatgatacaagtgtgaaagtgtttgaattaagaaaggttaaatgttttatttttcccttatgatattataatgttcaaattacacaaaaaaatttttttgaagatttttttctttaattcttgagacatagttgaaaagtgcctacaaaatgtgtaattgtgtgcgtgtgtgttgtggggggagtagacagagggagagaggaaggaaggaaaggacacagaaattgagatgtatttgctttagagcaacaggaatatcaaatcaatgaatatttcactttgttgttggaatagaatggttgtgcactgacatctggaataaatagctgagaagatgaaggcagaagaattatctctattttaattagataaataatttacagctctacactagccttgtctgtgtccctggattatgcattctatttgtaggtaaaacaaatgtgaatgtacttctagatactggccttggctatcattcctcctttactttgagtgttattgtgcttagaagtaaataaccatgaactttgaaagaaaatacctacaaacaatgtagtcctaaagtttaacattgagcattttgggattactattcctacttaggttagagctttgcaattgaacacaatgtgtttaaattatgtaaatagaaatacaaatttaacatgaacccatttgtatatagagagttagaagtttgggatatttttatccttagatgttcttttatctttttttgctgagaagttacttttgggatcaaaaggatctacttttcatgtgttaaacatccacctttcaataccttaatccctctcccttaaaccaaggatcttgttattgttgttgttgttattgtcacttaagccaactaacttgagcatatcaaggagactgttgattcagccagccaggcacatacccatgcatctagccaatagtcattattttcaaccacagttcactcagtgttttagtgggaattagcagggcatgggaagggattaggactaagaagtcattgaaatatttacttattaagatatgttgaaaaatagtgatttggtaatacttttaataggtgaattaggaacaagtgaattgatagattggagcatagatttttctagttggagtaattgacataagtaaaactctgaggagaaaatgctctctccctttatgaagattggacctacctggtgcgttggtatgtgttggggtaccattgctaagggaacagtagatgatggagcacctaaaggctgatgcttgatggagaaggcacaccatgatcaaattgttggacattaacataggtccttacaaagtaacttgtattttagttgattcatacactaaaaatggaaataggatttctagaaaaatatgtcaaaattgtgtgcatgctgggttggaaagtaaagaaagcagaatttggaagaccattaaggaggctgttagtttaaaatatgagggggcaaataatttgctggaatataaagaagaattagaatataaatgccaaagaatacaatttcccatgtagtgaagggagggtgataactgggacctcaactagggaactttatgaaggtaaaaacacattgtttcagagtttatcaattcagctacaactgtttacttgttggattccttttaaaattgcattcctattttcatccataaaacatcattatctgcagtccattttgctttgatatttttatttgcaatctaagttaataatatgcctatgctttctctatacatatgtgacttttattaacctgactgtgttagtatctttataatttctttctgatcattttgaacagctttctcatcattttgaacagctttctcataataaatatgaaacatcactaagtattatttttagcttatgtagatatatgtttcatggtaaaattaaactctttttctggttaagaataactgaagtatatcgaacatggaacatcaaatattaatgatgttgaaaatcgctgggattgtttcatgtattgtaacagacaaaacgataaagttgcagatctctggaaatgaattcatccctgtgggttttaactctgtgtcccatatgggaaatgtagacactatgtttcagcgcatgggaatactaatggaattgattaaatgattcttcctaaaactagagaacattctgtctttagttgttcacacgttgtcaagcatgacgttttcctttcgaaccattggacagagtcgtctcactctctgcagatggagccttaacacagcttcatgaagtaagctgttgccttgtctcactattcagattatgccccaaatcccttttaagagaggaagatggcataaccaacttggagatgctccagaacacagtttaaaaggcaggaagaggtctttgtcctttaatttcatgtaagagatatataagcaaatagaagaagatagaaataaaggctggtttgctttattatgtgtcaaaagtggatattcttagcagtcaaggacttgaaaccaaccttcaaactctggaaatatgtcttcttgtaggctttttctttggcataattcttccttcttggagccgacttttttagagcatagaggagggatcaccacattttgcttgaggaagatgaagggaccaagtgtgactggtttgaaagaccaggagacaataattaggcaaacatgggagagttccaagtagaaaggacagcacggaaaaaggctcggccttgcagatacacttcctaaatcagggaactgtttagtgtgctgtccaccagcaggcttagattataacatcagggtcacaggaaggccaaaaggacactaaagagctccacaaagaacagggatttgaaaatatttcactttcaaaccatcatcttggactagttagaaggcaacactctatgcaagaaatgatgatagaaggaatgatcttcctaagtaagaaatgatccacaattatataaaattactaggtagaccagactgaattagtatgtggaaatgttgaaaaaagagaaaaacaggaaggttccatagttttcagcaattaggtacttcctggtaccattagacaagactggaacccaggataaaaaatgccagggaagaaggagctaacatcaattgactcctgttttgtttgtttgttttgttttaacaatgctctcaaaaatagagcaaattctgtcagccattatttgtaaggataacatttactttaacttgctccctcaattatattttctccaatgtttaaaaattttcctttttttcctctccatgatgaaatacaatttcattttccttgaattgtaaaacaaacaaacaaaccaaaaaacaaacaacaacaacaaaaaaaaaaacaggtgcatcgtgtgactccgggtcattctctatcaactgtccatggtataaccacatgtaatactacattagctctcagttttccagaatgatctgtcatatagtttgcacagaatagattcagctttttggcaagtcggctggaaaaagctcctctctctctccagaaaccccaagttaatacaggtgttcttattatagatagcatcatttaaccctgtggagtctaagaaatttgctgaatataaacatgttcaatattacagtaatatatggttagtttatacagttaaattatcataagattagtgacaaaaaataaacaaaagaatatttttcctacagtatccttgggaaaataagttgccattctaggtattaaggagaaatttaagaaaataattttactgattgactgtaatttccatgattttcatttcatatgtcctaaatgtaattattttatgcaatcagttttctgtctatattttatattttatgatatttcatgtcttctacattctctatgatactaaatgctatcatatcctcatattcatttttatgactctttaaagcattttattttgctgtatttgaatttttgttagtgtattcagacatttagaatataaattgtatacaagattatgcacatcttttttcccccttctgctgatcatatcatctcaagtctcacatttgcaatgtattacaatttaatctatgatgtttattactgagaaggcaacacatatactttatctgcgaataaacgaatttccctgaagattataattataatgatattttgctttggatttcatctggaactattttaaaagctttagttaggaggctgtagtaaaatagcctcagcgtggtgactcatgcctgtaatcccagcactttgggaggctgaggtgggcagatcatttgaggtcaggagttgagaccagcccggccaacatggagaaactatatctttactaaaaatacaggaaattagctgggcatggtagcacatgcctataatcctagctactcaggaggctgaggctggagaatctcttgaacccgggaggtggaggttgcagtgagccaagattggtccaccacactctagccttggcgacagagccagacccctgtcaaaaaaaaggaagctaaaatagaaaaacccaactcttaactcttaatatacatacactttcttttataacctcctccatgttaccatgttaactttgtctctagaatctctcaggaaatcctctacttttcaatctaagagtgctccggtacacattaaagtctgggcccctagacatcattaccctcattagtctcaaggtccatgctttggtttagaaataggctcacttagggccaggtgtggtggctcacacctgtaatcccaactctttaagaggccaaggcgggtggatcacctgaggtcaagagttccagactagcctggccagcatggtgaaaccccatctctaataaaaatacaaaattagcagggtgtggtggcatgcgcctgtaatcccagctactgggggtactgaggcaggagaatcggttgaacctgggaggcagaggttgcagtgagccgagattgctacactgccctccagcctaggcaacaaagtgagactccatctcaaaaaaaaaagcaataggttcacttcgaataaagattagaggacatttttaacagaatgcagttgtggaatctgatctttatgtacaaaatgaaatggctaaagctttgggaacattgcacataggccaagtgtgaaatggcaggacctggaggatgtagttagaccacaaaggacacagaaggcatagatgatgtgggggcagcttttccattctcttgacaactcatgctggcctatcagttgtggggaagttgtcataaaatagttctcagaaggatgtctaaagaggaactcacaccctgattatcatgacattttatgtaaatataaaaaagtaagggtgatttgatgacatccatcgctttttacatatgcattcttcgtaagtggtgtcctacagaaatatgtggttatgggggtcaagatataaagttataccctgcttcgatatttgagcagagaaatgaaacatatcaaaatgtaagttatataaacgataccaaagaacacattactatacattttaaagctatcttctgtatgctttaaagttaaatattacatttatttacacatgcagacttcatcttattttattatgcttaacttaatagcctttgcagacagtgcattttttataaattgaaggtttgtggcaaccgtgtccagcaagtctgttaacaccatttttccaacagctcactgttgacatgtgctcacttcatttcttggtattacatttgatatttctcacaatatttcaaactttttcattattattatatttgttatggtgatctgcgatcagtgattatcaaagttattaggttaatgcaaaagttattgcagtttttgccattaccttttttttggcaaaaactgcaattacttttgcaccaatctaatactatattattttaaggtgccataaactatactcatataagacagcatagttaataaaagttgtatgtgttctcactgcttcagccattttcctatccaactcccagaagagaggttctaactttctttaattctgtgaaggctgattgaggtggggggaagttaaagaagagaagatggaaattagcagatcttcatttatgaggtttaagaaaagaagctatttccataaaaattgtaaggtgaagcaacaagtactaatgtagaagctgcagtgggttatccagaagatctagctaagaacattgatggaggtggctacactaaacaagagattttcaatagacaaaacatccttatattgccttatattggaagatgtcctgtaggactttcatagctgtagaggagaagtcaatgcctggcttcaaagtttcaaaggacaggctgactctcttgttagggactaatgcagctggtaactttaatgtttatttatcactccaaaaatctcggggccctgaagaattatgctgaatctactctgtctgtgctctataaacagaataacaaaggtgacagcacatctgtttatggcatggtttactggatattttaagcccactgttgacacctactgctcagaaaaaaatgatgtattttaaaatatcactactcactgacaatgtactttgtcacccgagtgctctgagggagaagtacaaggcaattaatgttttcatgcctgctaatacaacatctgctttgaaacccgtggatcaaggagtaatttcaactttcaaaccttattatttaagaaatacattttgtaagactagttgccgtaggtagagatttctctcatatatctgggcaacatcaattaaaaactttcaggagagtattcgccaatctaggtgccattaagaacattttcattattcacggtaggaggtcaaaacatcgacattaacaggactttgaaagaagttgattccaaccctcgtgggtgactttgaggggttcaagacttcagtgcagaagtaactgcagatatagaggaaagaacaagagaactagaatcagaaatggagcctgaagatgtgactgaattgctacaatctcacgataaaatttgagtggatgaagagttgcttcttatgaatgaaaaaagttttcttgagatagaatctattcttggcaaagatattgtaaaaatttagaatattatttaaatttagttgataaagtagcagcagggtttgagaggattgactccaattttgaaagaagtttgatgggtaaaatgctatcaaacagtatcatgtgctacagagaaatcttttgtgaaaggaatagttaatcaatgtggcaaacttcactgttgtcttattttaagaaattgacacagccaccctaaccttcagcaaccaccaccctgatctgttagcagccatgaacgtctaagcaagcccctccaccagcaaaaagattaagacttgctgaaggctcagatgatcgctagcagtttttaggaaggatttttaaattaaagtatatacattgttttttagacataatgctattgcatattttatagactacaggatagtgtaaacataacatattcactgagaactcaaaaaatatgtgtgtgactcactttattacaatattcacattattgtaatgggctggaatggaacccacaatatcttggaatatgtttgaaagatatttagagctatttaaagcatagtgcatactactgtatgtatagcagtattcctgtatttcatactccctcataatgatgtaatatttaattcagtcttattatgacagcaatgaaaaatactatgtcttagggttccttcttttttttttttttttttttttggagatggagtcttgctctgtcaccaagctggagtgtagtgacacaatctcggctaactgcaacttctgccacctcggttcaagcgattctcctgcctcagcctcccaagtagctgggattacaggcacgtgtcaccacgcccagctaatttttgcatttttagtagagacagggttacaccatgttggccaggatggtctcgacctcctgaccttgtgatccacccacctcagcctcctaaagtgctgggattacaggcgtgagccaccatgccagcctaggtttctttctttaaaaatgtatttgagtattgcagtgtgtgcatgacaagagatttagactatcttcttaatgggttacaattttccaaattatagtacttgctaatcatcacacaaagcaacaaggttcacttcccgattttcagttcagttattatattgataatccacagagataaacacacatcagtttgtgaagcccgaactctccttatgtctagcatttaaggttttcagaagatagccttatcatctagttgatctaagaaactctttgtttttttaagaccaaatcagatttggcataggtttagaaatacaaaatcaaagtccttggacaaaaatgatccattctctaaagggtagagatatttggatctactcattttgggtatgaggagcttgattctaattatgatgggttacacacttcagaaacttacctataagaattccaaatgccattttttgctgcagattttgatctttaaatttaaaaaaaattagattttaaatctggtcttttaagagaacacacaaagcattggtgcagaataattgaacataattttgtacatttatatacaggttaatgtattggcaacccaagatgtgcaaaatgaagttaacatcataactgttaatacttttttactacagaattaacaaaactcctagtcaagaggagctgcagaaagtgattctacaatgcccctgtttagatcatgtttcttgtttttcataatgtttcccccatcacatactaattctctcccttttagcaatctagaatgcatactttctgaatcggaatgtatggtttttggggaaagctgttgttcatatgaattacatagaaattttagcctttttgtctggaagtgctcaaaatgtccactttcagtttagcaggtgatgaattgattttcttttatttactcttgccactcattctaaggtcctaatgagaaccctggtcatctctggtttgggctattaaaggtgacaccttatttctttgcctcaagccttgtcccagcttaaatccacattcacactataaacagcgtgatctctctaaaatataaatctgactatgccactctgaataaataagactcaaacttgttcacatgaagaagtcttcccaacttgacccccatctccttctccagcctcagataacattttttcttacttcgcaacgtacaccttggtaatatcagtggtgatgttatttctctccccacagcatgttgaatattttgtgtatttggttattttgcactttctgccaatcttatctttccatagttgagtgattcttatgcatcctaggaataattataatgttctcgttatgaggatttctgtgaaccacacatttgtgtcatcctggttggaagacttggcagcctccctgccaagtacactaggtcttttgaggcagggacttgctctcattcatctgggttcttctagcatccagcccaatgcttggcacatggtgggcaacaaatgtttgtttaactgaacagaacaaagctcatgttttttatctttctcaattgctaatttgcaaattaaacatgcaaagtaagtacaatggcagctgcagccaactcacatatggaggaagtggcccaagaaaacactttcatctgcttaatttttcactgaaatttgttaagctactgctgaataatattctcaggtctccaaaatgaacccaatacctgtagtcttaggcgatgtttaaaaagcagacacttaatgtatgtcaggataacagatttacatttagcgcatgaatattttgtgtatgctgtaaaaaaatctggtatttcatgttttttttctgattttttatcatgatactctcagagtatttctttcttatcttcatctttatggctcctgcagtagataagacagtgtcacaaaaaggaaaacgatttgcactttcctttcagagaaaagggataatgaaaagatgaattgagcacctggcaaattgcttactttcctgtcctttttctttttattatgtttaacaatttatatttcctgcaataaatacacataattcctatccattccttctcagcctccctgatacttccagtacaaattaaaaagtaatatcagaacattggacccagaagtgggagatgtattttaatttcagagaaaaagaaggtttctttctactagagtgttttgtattgatggacagctaacgttgaaggtttcaatgtttatctgctagggaaaagtgaatgggagacaaactaaaatcttttgagtacacggtatgtgccagggactgttgaaggcttttacatgtgttattattttttcttcccaaactccagaaagttaattgatattgggctattttttaaaaaagaaaaatctaaaggagctaatccaatattaattgttttaaaaatagcattagatatttttaaattttgagttttaaatttttatattatattgattgtccatcttatttttattattctctttcttctaatttcttaaagtggatgcttagatcatcgacttgtagtctttcttattttaaaatttatgcatttatgactatgaatttccctggaacacagatttagtacatatcagaagtttggagctataccctctttttattattatttaattcaaagtacattctaattttctttttgatttctttttgacccataagtgatttggaaatacattgcttaaattgaacatatttggatattccccctccttttaaaaattttatttgtaacttaattccactttggtgaggaaacattgtatatttcaaacattttcacatttgtttattacttactctacggcctattttggtaaatattctgtgtgcatttgataagaatgtatattctgcaacttgtggttgcagttttaaatgaatgtcaatttggtcagtttgttaacctttttgttcatctcttctatagccttcttgaccttttgtttttttttttttgtcctattagatattgatgtacaactgctaaactcttcaactatgactttacatttgttcattttcctttcaattctgatagttattacattatatacttgatgttgtttaattaggtgcctacatatttaaaagtgttctttctcttgaattaagcctgtcgatgaaatgtccttctttatttttagcaattatttttgtcttaatgtttactttgatatcagaatactcacagaattttctagtgtttagtatttgcatgctaagccatttttctgctttattttttcaactttttgtgtccttatatttaatgcattttttaaattgtaaaagttatttttaaattgtttttatttcagacacatttgtcttttaattgaagtatttagtgcatttatatttagtttaattaataataatcgaggtccatgcctacctttttagtttgtacttgtatttttcttgtatggttttcattcatttttttcttcttgtagcttattttggattaattgtatcttttgtatttcctctttattagtttgttagtattaattcctttataaaatgttcttagtggttccccaagagatcacaaaatgaatttttaagttatttatgttgactttaaataaaacgtactaatttccagactttatactggaatctacactactttaactctgtctgcctacctcatcatgaactattatggacatttgtgttaattgtacttatattttgaaccacatacttttttttttaatcagtgttaatctagatctgctcacagatttagcccttctgaggattttcattttcccttccttgtccttctttctggcattattttccatttatgtttttctttctaaagaaaaaaagaatattttgttgtctttatttctgctcttgttcttgcaaaatattttaacacttgaaataattattattaatttattttttctttttgtggcgaatggggtcttacaatgttgcccaggcaagtctcaaatccctggtctcaagttatcctcccacatctgcctacctaagtgctgggattacaggcatgagccaccatgcctggctaaataattaattatttaaggagatcatgtctttgactttcatcgttcgtattctcaacatatttagggctctccttgattctcttctcagaagcttggcccctcatgtcaagtgtgcgttgattcctcttcgaaatcacttctgctcttgtgtatgttctagtatatagctagctttgaaattcctgaaatagttttctgcaggaaatttattctaagaaacagtttttgtactgaatgtgaaaaacccagtaaccgagccttaaatgtacatgactctaaatgtccattttctgatgtgtacttctgtattcttttctgaataatagagtttgttaatacagtgaaattcaatagaaagaggatgaaataaagtaataaaaagtaaacagtataattcagtttttggtaatgcacattttgaaaagtcactgataagcccatgtattattgctctattctgtatgtggcatctcagtcttataaatgttgctgggtaattagtttatattttaagcaggcgagccattttgcaaactgatctgatccatgatgtaatagagaattcacagctactctagaattctctagaacaacccaccataaaggagaaggaattattttacattttggatgatatagcttaggaatcagaatagacttcctgtcccacattgcaatatgagtatttgggtattaacttagggaaataattaccctttcaatttcatccacttaagaggaaaagtttaatatttttttcccaaatattttattttcaaaaactttctaaattattttatgtaaaataatggatataaaatatttttatcagttggttccataaacacatttaattttagttagaataatttaattcttacctttaactctcattttttctcttccttccataaatgcgtagctttgactctaagttacccttgattgcaagatctgtcattaatttaccaaaacattttcaaggaaaaaagaagacattttgctctaaattatacaataattataagacatcccagaaacattaagttgtgaaaaaacacattatgaaattgagaaattatggaatataatagcgccaactaaatgctaattaccatgctaagcagtgaagacaagtagataaatgagacatatatcctgggttgcaagattctagaatctaggttagtcattaacaatgcaaacccacaagtgtgagtgtgatgtttgttgatagaaatataaagtagtgtgtagaacctatttatttggtaaattttaaggagcttgttatgttttgatattccagaagatcctgatggaagatgaggtgttagatacagtctgataatgaagggtcgtgcattccatatgaagatattttgggatgtcttccattagcaattatatcctcagatacatacgttaaaactaagaatggtggcaatgtgaaaaaatagactggaagagatcaatcagttttgtggctataataaatgcagaagattcttaatgctctgaattaagatggtagggatgaagaggcagaatagacagtggttttaaaagtaattcatgaaattcaaataaacagagcctagtaactagggatgggaaagatacagagagaaaagggaaacatttcatatttcttatgtgtggtattgtgtttctaaattgagtggttgttgagccctatcagcttttacaaggtaatgcaaaaataagtcattttttattatgctgaatttgaggtgcctgtgaatacgttggagaaccaattagacagttctgattcttaggagacaatctatactacagaggaacttgaaaaatataagcctgtaattttcaaaatcatgataatgggtatgattacagagaaaagggatgcaacatgcatttctgaacaccagaactaggataaagttagcagccggatctttatgcactgatctacccaaaccttcatggaatatatttactggtgacattcagagccctgccttaaaaatgcctttcatccattttctttagtgttacttaaaatgctacccttttagtttatcttagatgctctttacattttgcaactttttgtgagaagcacaagcatgaaataatctcttctaaaaactaaaagaggtaaactcaattataataaaatgaaacaaaaatattttctaatctaataactattcatctcgctagttgatgaatgtatatacatgaagcaaattttacctacctccaatctattttcagagctcaaaatgtatcactattaagatatattcaattaatttttctttctgttgggaggcactcgtgggaagatactgtaagaaaacagaaaatgagagatttttctccactgagaaagtccacaatgacatttgctggtctttaacattaggttccacaaatgaattacttttaatggtcttaaataataatgttaggttatttaaattttattcataatttgcatgtaatgctgattcttcctaaatttaaataaatacaagttatcatccaaaatatcatccagttatctgctatatcgtggcagaaaacattttgagtcaactttctatgtattttcatttttatcatatagctagtaattttaatacaatttctatattggactacatatattttcagatagaatatgatttcagtgcttgtgatttttgagtacgtaattaaatcaagtgagacaaatatatttaatatgctagcctaaatttagtatatgtttcttcataattccttaacatttaactaagctagctttaaaaaatagtcttagagacaatattttctacacgcttgtcttagcaaagtattggtcaaatactatttacttttttaaagtcatttttgaaggttttttgtattttctattttccagaatatttttatgtaattttcacttttgtggaataaaatgatcattgacaaaactcttattttttgtgaaagtaaggcataaataatttagtaatttctaaacgttaacttcttaatagataaagctgaattagcatttttcagaagaaaatcttaagagattatggtggctcagcacattaagagaagccaagtgactcaggattctaatggttcaccaaaatattttcaaaacgtcacttttgcccctgaaccttaagaatttgaggtttgctattatagaataatttagttataaaaatgtgactcatgaatggaattaaaaaagtctctatgtttacaaaacagcttagccattctaccaatctttgcattttatatgtaggtaatttccctaatgcatatagttagtaactttcaacaacacttaatttttgatcattattagctctcaaattgggaattaccagtattaagctacaggcattagtcatctgtaggcttagaaagaacatttgtttctagcaatagagacttctgtttttggtggaaaatatggcagatctcatgtctgaaacctgttagaaacaacttccatctataggtatttgacaaaatgcatcaaatttattattattgacgattgaatttatatttcttcggcaaaaatacacatgccagatgactaaatgacctaacatgagattttgggagaagaatggggtaaatagaataacaaacataccaatttttaaaattcaggcaaagaacttaatgagaacaattaggaacttactctgtcagatgaaaactaaaataaagtatcttctattcaacaccttgtcaggcacagctgtagttttctttaatgcttgctttagacttataccaaatgcttgctagtttcttagaacatgatatgaccacctccacaaattatgtcagttttgtacttaaatgtttttttcatgaaagcaaagactactagccttcaaaactaagctgtgagttttaaaaactgaggttttaaaattctgcctgatatccacgccacctataactttgtatatctcaagcaaatagcagatggtgtgtagggagggtggagctcagcatgcagctaaaatgaaaactcatggaatttgttggacttaatcaaattatctgcacattaaattgtttacagtatgaacacattgttcctttagaaattgagaattatatttttaaaaattatctttgccttttgtttatcaaagcttagagatttttcaaatttctataaaaattttttttcatccttaaatcactgaacatttcacttctgagccctctatttttcccattcattttgaccccattctgccctcttctcggtctccctacctaactcacccagagatactatgaagtatatggatgagttgagtcctttgcttgccaatttagtgtttgtatttagcttgcttgggatggttttaagaaaacatattaagaatattttctcaaattagtgccaccaagagaagcaaaatggtagtactgaccataaggcatactgacattttctgaagagttctgcgtgattggccacaatgagcagtgaacaaagtagctttattttgatgttgggtggctgacatggtttgaacgtttggtccctccaaatttcatgttgaaaagtaatccccagtgttagaagtgggaccagccagacgcggtaactcatgtctgtaatcccagcacattgggaggccgaggcaggcaaatcacctgagggcaggagttcgagaccagcctggccaacagggtgaaaccccacctctactaaaaatacaaaatttagccaggcgtgttggcacatgcctgtggtcccagctattcgggaggctgaggcaggagaatcgcttgaatccaggaggtggaggttgcagtgagctgagattgcaccattgcactccagcctgggcaacaagaacgaaactccacttcaaaaaaaaaaaaaaaagggacctagtgggagatgtttagatgccctcatctcatggaagtgcatccccatgaatggcttggtgccctctccaagtaattggtgaattcttgctctattagttcatacaagagttggttgtttaaaaagaacctggtacctctcttgttccttctcttaccttatgatacatctgctccccttcgcccttcatcatgactcagatattcctaaggcctcacttgaagaagattctggtaccatgcttgtaccatgctttgttctgaacaaagatgaacatgttttcatgacatttacaaagtaagtattcaattattgttcattgtcttattggaaaacacatgtaatgtggaaagttcttataaataagtaattctcaaaggcataaaagagctcagaataaggaataaattatctaaagtaaatattacagcatttttttttcttgtcacccagactggagtgcaatggcacaatctcggctcactggaaccttcacttcccaggttcaagcgattctcctgcctcagcctcctgagtagctgggattacaggcatgcaggattacaggcgtacaggattacaggcgtgcaggattacgggcgtgcaggattataggcgtgcaggattacaggcgtacaggattgtacgacctgcagaatcatgagccacataaacctcttttctttatagattgcccagtctcaggaattcctttatagcaatgctaaatggactaatacagtgaccaagaagtgctttgggttttgagtgttcaaaagcagagatcatcttttacttcacaccgtgttctgtaaatggtgggtgcccaagtgaattctactattgacatgactaatctagagttctttaaaagtcaggaatatagtcaatacataaaccagtaacatagtcatttattatcattgccaagtgttatgcactgtacataattgtttgtaatatacttttacactactagtggtccaataggcttgtttacaccagcatcaccaaagatatgtgactaatgcattgtgctatgacattataatgcctatgatgtcattacgtgatagaaatttttcagctacattataatcttaccgatccacagtcatatatgctgtctcttggtgaccaaaacatggtgacgctctgcatcaatgcaatataatttgcatttatattaagatttgtttttattttattactactaattaataactatcttttaaagagagattttatacaaatatgccagtaagcatccttgttaaaataaatctgaaggctatatttcactagaagtttttactcagtaaatttagctattttgagatattatttatttctgtttcagcaacgtaaagccaatattattgagaacaaaaatgattatcttctttatagagaattgcaattattttcaaatttttttaaagaaaaccttgatatcgttaatattttgtgcacaaagataaaataacttggtaatgaggtggtcattctttaaaacaggtggcatagatcctcggaggtgaagactctatgttagtttattcacatttttatacatgcctccttctaagaatcctttctacaagaaaacttttttttatgccatgtgctgtgggtcgcgctataatcccagtgctttggaaggatgaggtaggagaattgctcgaggccaggagttgcagaccagcctgagcaacatagcaagatgccatctctacacataaagaaaaaattaggcatggtggtgcatgcctgtgactaattggaaggctgaggttggaggatcccttgagcccagaagttcaagactgcagtaagctatgattgcaccactgcattccagcctgggcaatagagtgagatcctgtttctaaaaaatgtaaataaataaaaataaaagaaaacattgttttagtctcacagaccttgtggatgaaaccgaatttagaaaggtttgtgactgcctttatatttttatgtaggtctatttctaaataactctagacatatgacatttatcttccaaatctatttgtgttttaagattcataaatagacagggggcagtggttcacacctgtaatcccagcactttgggaggccaaggagggcagatcatgaggtcaggagtttgagaccagcctgaccaacgtggtgaaacccagtctccactaaaaatacaaaaaaattagctgggcgtggtggcacacgcctgtaatcccagctactcaggaggctgaggccggagaatcacttgaaccctggagtcggaggttgcaatgagctgagatcacaccactgcactccagcctgggtgacagagcaagactctgcctcaaaaaaaaaaaaaagattcataaatagttctaatggttgtttgcaatagaggctcataatttgtattctacttttgattaatgattttgtttgtgaaaaaaattttacagtgatatcatctatgcattcattacatttcacagcctgattagtgtatttgtccttctcagagactaagaatggaccacttaataacaataattaggaatagcaattccttcttgcttcccaaattaggcagaatttaggatcaaatcttaatataactataatcagttttctctttatatgacgccaggattttaaactcctaaaatctagggccatttgtttctagctttcctataaaatttccacactaattcttcagcctgttagagcttgagagagattttttgccggaagaaaaaagtattaactctgtatttcacagatctaatttaggcctaagtaaggaaaactcaagaaggatgtactttgaaaactattataagttgcaccaaatgccacatataaaatatacaatataaagcactgttctgaacaaagacaaatatggtttcatgacatttataaagtaagcattcaataattgttcattgtcttattggaaaacacttgtagtgtggagggttcttataaataagtcattctcaagggtataaaagggctcaaataaggaataaggttggtaaagtaaatattatagcatttttttttcttgtcgcccaggctggagtgcaatggctcaatctcggctcactgcaaccttcacttcccaggttcaagcgattctcttgcctcagcctcccgagtagctgggattacaggcatctgccaccacacccagctaactttttgtatttttagtagagacagggtttcacagtgttagccaggatggtcttaatctcctgacctcatgatctgcccacctcagcctcccaaagtgctgtgattacaggcatgagccaccacacccagcctattatatagcattttttttttttaaaaagtaaaggactgattacatttgaaataaattaacataaactgagaaaccttgaaactagcaaagaagactgagaccaaacgttcaaaccatgtcagccacccaacatcaaaataaagctactttgttcactactcattgtggccaatcacgcagaactcttcagaaaatgtcagtatgtcttaataattattgcacagagatccactgagtgttttttacagggaaatgatcaagtgacagtagtgagccaatttaattgagggtcttttgggtgcaaattagaaaagagaacagctaaagacaagggaacagaacctggttctgaacctttaataaaagtacaaattgaagagttgcaagtaagaagagcagcactggcaatcagatgttgaaattaaaaaatatatatatatatatatatatatatggcaaaaattaaaacaacctggtttcagattgaatataggcagtaagagagatagatttaattaaaatgcacttttatttttcaagctttgatcgtggaagtcaaattgaaagagatgaaagttcagttttgagtagaacaaagcattaaattgggcatgctctgtaggagttaccatgtttgggacaaaagtttaaataggaatgccagaaatatgatgataattcataatggcattttaattttctaaataaactaattgttaaattatcgttaaaagaccattttagagatgattaatgctagcttttaaagcatggctaagcgcctatgctgtgggcccactactcgcaggcacacaatcaagcttgaaaacaggattgttttcctctatctttgtgttttattcttttcatagtctctcagagatagaatgaatgagttagatctcaggtacataaaataaagagcacatgttgacttggaaaaaaacacttttttttttaagtggaagaatgttatgaagttagtcaaacctccaataaggagacatttctcctcacataggtaaaataacagcaacaacaaagggcaattgagtttagtttgcttgtttattcatttatttattttgagacagcgtcttgctctgtcacctaggctgtagtgcagtggcgcaatcttggctcactgcaacttccgtctcccaggttcaagtgattctcctgcctcagcctcccgagtagcttggactataggcggtgccaccatgcctggataatctttttgtatttttagtagtgacaggatttcactgtgttagccaggatggtctccatctcttgacctcatgatccgcctgcctcagcctcccgaagtgctgggattacaggcgtgagccactgcacactgccaagtttattttttaaccatagtttgaactgcttaggcttatttctcagagtttatttatttatttgtcttgcatcttcacaaggactgtctttaaaaaaaacagtgattttgtacagtaaaaagacatttcactactgggctaaaaacttcatgaggaaagtaacatgtccatttcactcgttattatattgtctgtccctaacttgggtcccacactcggtggttgtggcttatagcttaactctgctgctgcaatttgtgtggacttaggcaaataaattaatattctatgtctcagtttcctcagattatgaaatacagttaataacacagaaattcttgcctaataattggcttaataggtgttaaatctcctcaaaatttaaaccccatataaatgtaaatcttagcattatatcataatatttctctgaggtaaatgaaaatttgatgataaccttcaatgtatgaagaagtatcataagaagctacaataagcttttctagtatcacatactacaaggtagccttaagttatggtattaagtatttgagttagttatagaaaggtgatattttcatctcaaagaattctcattatttgtacgtttttaaagacataagatgaaatctttgttacctggtttaatataattgtaccacttacagaaacaaatattagtcttccaaaatcccatgctttttcagattatatagataaatttaatgacaaacatgatgtatatatacatccatatacacacatactcatagaaaaaagtctttcatcttttaaaagttatacagctctggaatttaactagcatactagaaggcaataattaatatagaagaaaaagagaccaaggaatagggaacaccagagggttttggataaggtcagaaaaatgtgtgctactgtagcaataacgcttgaacaaagaagtgaggaagtgggctgggtgcaatggctcacacctgtaatctcagcactgtgggaggccgaggcgggcggatcacgaggtcaggagatcgagaccatcctggccaacatggtgaaatcctgtctctactaaaaatacaaaaattagctgggcatggtggcacacacttgtagtcccagctattagggaggctgaggcaggcgaatcgcttgaacccaggaggcagagtttgcagtaagctgagattgagccactgcactccagcctgggcgacagagcaacactctgtcacgaaaaaaaaaaaaaaaaatgaagtgaggaagtgaaagaggaagtcgtgttccctacctgagggaagaacattacaggtacaaggaacagccagtgcaaaaatcttgaggcaagagcatccctgtcatgcatgaggagcggcaaggctagcggggctggagctcagcaaagataaggtcagagaggtagcaagtgttgaaactgtgaagcctttatattgctaggactaggctatcgccctgagtatacttaggggctatcaaagtgttttaagaaagggagtgacgtcatctaactttttaaaaaagttattcaggctgcttcctagagaataaaactaagttgtaataatgaacaatttattttctacagagtgcttttcagatgctttaactgttcatgccacaaatatttatagagcctggcctgtgccagatattgtgctgggcactgtgtagaggacactgagcaaaaacctgctgcgccttacccttgtggagagcgacattccttaaagaatcaaagacatgattgaggtcagattctcggtggaatgacattgtcaggaagatcaggggaagttgtctcaggaagtaattgttgcagaagtgtagaagttcagtaagtgaaaatgaaggtgtggcggaggtgtggtttgggagcgcattgcaggcactggggtgctgcagtacacggaccggctgtgcatcagggaggacctcaaggattccagtctatcggctgcagtgagagatgaaactccagctaagcaggggccacagaacaaagagttttgaaatccaagctgagagtttgtctttattctaactaatctaagatgtgccgtggtatctttttataattagcaagtaagcataaattggagaaataacaaattgatattcaacgtcttctgatagaaatgggccaatggagatgcaatcagacccactaagttccctttgaatggtcgacaagaaaaggatggtccgacagactgccaggaggttggtggaaaaagatggaggcaaaggagtagaggaagagatgccaagagaccagaaaactgatggatcttttgacccaagttaaagcagtgtcaagaaaaatggaggggtcattagtgggcagtttagatgagaactgaatcatgtactttggtgaacatgggaaaccatgagaatggtttgtgtgtggtaagagatcgagaacggccagcagcggtggctcacacctggaatctcagcactttgggaggccgaggcgggtgaatcacttgaggtcaggagatcgagaccatcctggctaacacggtgaaaccccgtctctactaaaaatataaaaaaaattagccgcgcgtggtggcgggcgcctgtagtcccacctactcaggaggctgaggcaggagaatggcgtgaacccgggaggcggagcttgcagtgagccgagatcgcgccactgcactccagcctgggcgacagagcgagactccctctcaaaaagaaaaaaaaaaagaagagatcgagaccatcctggccaacatcgtgaaaccccgtctatactaaaaatacaaaaattagctgggcgtggtgacacatgcctgtagtcccagctactcgggaggctgaggcaggcgaattgcttgaacccgggaggcagaggtggcagggagctgagatctcgccactgcactccagcctgggcgagagagcaggactttgtctcaaaaaataaataaatacataaataaaagaaaatgacaaaaagatgtaaaaatgcaagcagcaattagaagcagtttggctacgaagagaaataaaccaggacagcagcttatacttaagctgccagaagggcatgcagagtaaaggagagttttatatttatttgtaaaattttttaaaaagattcaataatagttggaagccaatgtgaaaatccagttgagaaagttgggtatgcatgaaaggcagcatgactgactgtacaaggatctttagatatcaggagagaagttgactttatatatatatacataaatttattatttaaatttatattaaataatatatatattatttgaatacatatattaatatataatataattattaaatacattaaatacatatatacattaaatacataaataattattaaatacatatattaatatataatataatataatagataatatattataaataatataatagataatatatactatatattaatttttaattttgtttggatacatagtgagtgtatacatttatttacatgagctattttgatgcaggcatgcaatggataaccatcacatcaagtaagtagggtatccatcacctcaagtatttatactttttgttccaaacaatccacttatactcttttagttatttttaaatgaacaatgaaattattttttactgtagtcatccttttgtgctagcaaatactagttcttatttattttttccaactatttttttgtatccatgagaaactgactttaaatagacagggagatcttcccacttgtcaatagtgaagggattttcacttggaacatagaggagactctgaatgggtcaaggtgcatttcctggcagatctgtgtacttgccaccggggagagaggggcattctaatctgatggtttctataatccctagagtaggatgaccatgtaatttgtcactgaaacgggaacactttggagaatgaaaataggcactattaataatgaagctaggattgttttagcaaactggaacttgtggtcactatcttaagttgaattcccccagaaactgttctggtacagagatttgagttttggtattagatctgatagatgaggaaaacatcagtaggggagtaggaaattaatatggctaatacaatttggggaaataaggaaaccagtaaagcacacattacaagccatgtatcactttgagcagttggaaccacatccacctggggaaccacttagagccagtgtagatcatacaccttaagagttctgtcaccccaagagagaagctcagatatttatactcagctcctgtgagtcactggatgaggggtgctcttagatgggcattaatttccctgcacttgcctcagtagcagaaaaagtatttgtgaggctgaatacaccttcagacaaagaaatgcaaaggctacagattgaaaggaaactgtcagataactagggaagggctaggggaaatgcaacagggagagggcaccaacagctttcagcctaagtttcagagtaagttacagtgcaactgaaggtgatctgagagtcaagggataggtgggaagttgaaaggaaattttatgagcatggaaaaaatagaaacaattatatgagaaaacatgattacttagcagtactgagacctctgcaccacagctaggaatattctaatagtccttgaaataattatttgtatctttatctacagaaaaggaactggcatgatgggaaagtaaatatacaaggtcaaaaaaacaataaacacaaaggttggaaaacaaaatcatgtactccggcttcagaagctctatgttcttttcaaaataacatctgacaaagatatgttcgatgaagtctttttgttttgttttgaatttagtttttttaatttttaaattttatttggtgatggatcatttttagtttgtgtttttaagggaaaagacttcattgtttctctttgattctttcaggaaaatggctacaaaccatttgcatgtgttcaaaatatttatgtttcattctctctaatatttctaagttcctccttataatttaatattataaccttatgatgatgaatactaatcaaatgagtgtacagttgctccattgttaccagaagtatgtaagaagtgagatgatctgaaattgttaaggatattttctagaaaaaccggtaagtttttttttttttttttttttgaaacggagtctcgctctgtcacccaggctgaagtgcagtggcacaatcttggctcacggtaacactggtctcccaggttccagcaattctcctgcctcagcctcccaagcatctgggactacaggcatgcgccaccatgcccaactgatttttgtatttttagtagagatggggtttcaccatgttggtcaggctggtcgcaaactcctgacctcaggtgatccacccacctaggcctcccaaagtgctgggattacaggtgtgagccaccatgcccagcccacgccgtaagtttttataattgtataattacattagtggaataaatgaatggataattggtaacattcaggcagtgtatttaggtgatgagttttctaatcagttaactatgagacacaaatccatggcaaatcagaccacattagtatagcattttccccatggatctactcaatactctggaaaattaagtatttaattaaaaagaccagaaattgtccaatttcttatctcactaacagatttgtgactaaaagttaaggatattgaatgaatacagacaagatgaatttgtttttccctatgttgcattctccattaaatttagtatttttttccatttgcaactttagatgagtatttgctattcttcaacttttacactgtacacgttctgatatgagtgaactaaccgccgtagtagaactttgttttcaagtctactaggttgcttttgtgaagcctagtactgcttctacttttgtaaataaataattatttgaaagtgtgtttcaaagatttcaaacatgttatcttttggtaataccgatgacataatgtcaattagtgctattttcctttccttcagtgaaatgtagtatagaatttctgcaatttgaccattttcaatttgactatttttttcttttggggtattaaaatttagaaggtcatgggagatctttctcttctagaaaattttaagttttatttatttatgtattgagacagagtctcactctgtcacccaggctggagtgcagtggcatgatcttggcttaccgtaatctccatctcctgggttcaagtgattccactgcctcagcctcctgaatagctggaattacaggtgcacatcaacacacccggctaatttttgtatttttagtagagacggggtttcaccatgttggctgggctcgtctcaaactcctgaccactagtgatcctcctgcctcggcctccccacatgctgggattaaagatatgaaccttttataaaaagttaaagtaacatttttgcattttagtttttgtgtcttttagcttctctgcattataattataataatgctttggaatttcataatgggaacaaaattctaatcaatcctggaatatagataaccaacatagagtgaagattataaaatgtaaagcttcagcatagtttccattaaggaaagattagctatttagatgtataatgtgcttttgaaataatgtcaaaaacataaacacaaaaatattcattagaatttattcagaatgtattttctacaatatggagacaacagtttttggtaaaggaaacacaattcttaggagtttttctaagagactttcagaagaattttttatagattcagataaataaatgattcaaatgaactctagttgcattagtaaagaaacaaggtaggctgggcgcagtggctcacgcctgtaatcccagcactttgggaggccgaggagggcagatcacgaggtcaggagatcgagaccattctggccaacacggtgaaaccccgtctctactaaaaatacaaaaaaaaaaaaattagctggtcgtggtggtgggcacctgtagtcccagctacttgggaggctgaggcaggagaatggcatgaacctgggaggcgaagcttgcagtgagccgagatcgcgccactgcactccagcctggacaacagtgagactccgtcttaaaaaaaaaaaaaaaaaaagaagaaacagggtatttggaaaacattgtatgatacatgaaaataaatttgatatgtctgtgaagtatcttgctatagaagttaattatttttatctttcatgttgtcaaattgaattatgatttatggtttgcatctactccaatgaactgcaaagcattcatttcatgtaaattattaaaatgcaaaatagcatacaaattttttctatattgattcaagacattggactatcctatatgatagacagaagacagatttaccttttatttatactgtactcattgataccgtttttattgttttggaaatacaggctgatcatttacgtttgaatgaaaatgtgatgggaaacaaaaatatacactaatataacactcctcatttggcataagaaaatgggattaggtgtggtggctcacatctgtaatctcagcactttgggtggctgagatgggaggatctcttgaggcaggagttctagaccaggctgggcaatattgtgagacctcatctctacaaaaaattaaaaatttagccaggtgtggtggtgcatgcctgctactcccagctacttgggaggctgaagtggtaagatcacttgagcccaagaggtggaggctgcagtgagccatgatggcgccactgcactccagcctgggtgacagagcaagactctgttgcaaaaaaaaaaaaaacaaaaacccaaaacataatgcattaaaagacaatatagctctattcttttgggcctaataataagagcttatatttgtttagctcttattatgtgcaagatcctcttctaattactatacatgtattttatcactaaaataaaatattaattgagcaacaactatgtatgagcaggtaaatgagaatccggagtttacattatggacctgagtagagcaagatgcaatttgtagagtaatcaggatacaatttgagcaaaatcttgaaggcaaatgaagaggttagttcaggagatatgtaagggaagaatgtttgcagtagagggcctcgccagggagaatgcccaagggccagtgtgtagtgggtgttagtgacacagcaaggaggagagtatggcagagtgagggagagagagtgaagtagaaggtgaggtcggagcagttatgagggacaacatcatgcacggtcttggcaatctgttgtagggattctgtctttactccaaaggaaatgagaagctactgcgggttttagagaaaagcactcttctctcaaggcctgattctattctcatctgactctcaagctatctcagttttattgccatgcatatttattattcattaacaaataacatatataatgcacagttcattttttctaccagcttctccctattctgcccacccccagcgtctgtaagtgccattctactctctgattctataagttaaaaaaaattttttttttgagatggaatctcactctgtcctccaggctggagtgcaatggcacagtctcggcttactgcaacctccgccttctgggttcaagcgattccccccaccttagcctcccgagtagctgggattacaggcatccaccatcatgcccggctaatttttgtgtttttgtcgagacggggtttcaccatgttggccaggctggtcttgaactcctgacgtcaggtgatctgcccgccttggcctcccaaagtgctgggattataggcgtgagccaccacacctggccgagttcaacttttttacattccacatatgagtaagatcacatgatatttgtctttctgcacctggcttatttcccttaacatagtggccttgaggttcatccatgtcgttgcaaatgacagaatttccttcttttttaaggctgaatgctattccattgtgtatgtacaccatatcctttttatctgttcatcctttgatgattaatcccatatcttggttgctgtgaataatgctataatgaacatggaactgaaggaatctcataggtatactgatttcctttcctttgagtatatacccagtagtgagattgctggatcatatggtaggtctatttttaattgtaataaacaacaaataacattaacaaatgacaagtataatatattatacatttttaataaaatttttaaaatatgagagtcctaacagttatggggttaatgtatcaactgatgataatgttccattagtttatcttttatttgtctggtaaaagattcaatatttagtataacttaatatgtctttataaatgataagaccagctccttcccttattactcttaattttcaaatgcaacaaggctgtaagatgaacattccattccatattgtttcttaatttaggtaataaagaattgaaacacagtaagtttatgagttcaatttctggaactttttggtgaaaatatagcattctagccaaactcccccagaaatacccttttgcctgccttttagtattatagcatctgttgaattttcaaactggcatcctcttgattagtcaactacatctaaggagtttaaaaatcaaataaaaaaataaaaataaaaataaaataaatggttgaaatgggagtcaggataatgctgagaaaatagggagaaaaccctaacacacaatggtgttcacttttatttaacttttttctgggaccaaagataaatggaatccaagtccctcagggacatttgcttcctagtcctgagatggtcaagcttgtttctgtcacatttgtgttctggattttgctcattcagtcataattacaaattactccaggtcttgtgacttgtcaagtgaaagaaaaataaaattagaaaaatatatagcttttgtaactaaaaattagtaagtgtaggccatatttagaatctcattatgagagcaaaccattggagctaccacaaaccttttgtctcaatactttagacggggtctctgtcacccaggctggagtgcagtgacacaatcatggctcactgcagcctccacctcccaggctcaagtaatcttcccacttgagctttctgagctgctgggattacaggtgtgtaccaccatgcccagctcattttttttttttaatttctttgtaaagacagttttgccatgttggccagacaggcctcgaactcctgggctcaagcgattcgcccgccttagcctcccaaagggctgggattacaggtatgagccacgacggctggtcaaagaaagaatttttaaacatattgctggttttaatagtaaaaagaaaattatacatattgtacatcatgcacaacataatgttttttgaggcagggtctcactctgttacctgccgggtgaggtgtcagagaccccacaccggaaaaaggtccactcacaggttggtaaaagtaaattatggacaccagtataggtgtgaaaaaggaaagtttattagaaaggaagaaagctgcaaaagggtgcagccgcgatccgtggtggattttccttaggggtatttatggatcttactgcgggagcttaagattgcaaaatgagtttcagcatggcattccagagatgcataaaaactttaattacttataaaagttgaaagaggctggaaccagatgtgaccagggggtctttattcccttctaaattcctcagataaggagtttttctcttcggtggtctgtttgagggtcactggacgacttccactctctcatcacccagctggagtgcagtggtgagatcacagctcatgcagtctttaaaatatacctgggctcaagggatcctcctgcctcaacttcctaagtagctgggactacaagtgcacacccccgcaccaggctaatttttgtactttttgtaaaattggggtcttattttgttgcccgggctggtctcaaactcctggactcaagcaattctcctgcctcagcctctcaaagttctagaattatgggcatgggacattgcacctggcgcataatataattttataaattattgcatgtaacttggccacacttgagaacaaaaggaaaatagtgaaagttactacagatcactggaatacatttttctctgtcattagttaaaaccactgtgaatgtctttcactccaattactttcaattccaagttcagtcttaatatgaatattatcagatgttgggtaaaaataatcttttcaattatctaaatttgctcaccatcaaatgtatataccttgtgaatacctattatctacctattgaagccacatgaagtgtcaacagtttttcatcgagaatacagaatatttattgtcttctatattttaattccaaataatgttatttatgtagtaagaagtgtctttaagaattagctcccatggctttccagtggtttgaggaaaacattaaactattaagtttgtacagcagctgtacagataataaaaccagtccttcgccccttaccacctcttaatgaagttgttaaattagatcttgcttttttttttttcttgagacggagtctcgctctgtcacccagactggagtgcagtggtgtgatctcgactcactgcaacctctgcctcctgggttcaagcgattctcctgcctcagcctcccgaatagctgggactacaggcatgcaccaccacactcggctaatttttgtatttttagtaaagacggggtttcactatgttgaccaggctggtctcgatctcctgacctcagatgatccgcccactttggcctcccagagtgctgggattacaggcatgagccactgtgcctggcctagatcttgcctttttaaaaatagaaaatatatatatatatatattagaatatatatatattctttttaaaaatagaaaatatatatatatactagaaatatatactagaaaagctaaagtaatatatatatactagtacatatatatatataatatatatgtactagtatatatatatactagaaaagctaaagtaactactagttgttggaaaaatacccatgaaacagaaacagcacagttctgatattactttctctatagtcttttcatcacacctcagcagcgaccagttacagccaaatgcagaaatgactatctttctttacattgtgaaatacatttctaaggtttcttcagttcaagatccatcttttggttctcttgctgtgaattcagtatatatttttccaatataatttgactggacatcatgttgaaactgaagggtagacattttagtgggtgaacttgacttatccttcttgtacaaaagataaccaaaggaataaaaacacatcagaaaatagaagtagaagatcagtcattggggttcttcagtgctgtgtccatgagccaaactctgtatgaaatgcaggacgtataaagctacatgaaacatattccttagtcttgagaactagttattaatctcatgtggcccacagtacaggagtgctgtacttcagtgtaaagcatattctagaaataataaagatctaatgttttatttagcatttctgccttttcagatattccatggacattcttctattttgcagtattcttattttcacttcacagtcaccagaggtgactgataggaattgaaaatgagctttgtgtgtattcataaaattctggggattagtaacatgaaataaaaagatttatgtgaagtgcaggttttcatatgtaggctgagccctcttaaggatgtgtcctgtggtgagcagaatacaaaaacagctaaaaggcatattctgttatcatatgttcatagtccttttaacctctctggaaacctttattttcagcctctaccgtctaaaagtcatatgagatatgatcaaaagaagcaaaggacattaagtatttaggcaatgggataaattggtcaagactgaatttgctgtaagaaaaaacagtgcatccgtattttgttatcagggtgctcaggcagattgtaatagaagcaacaaaatgacaggcttatgcttggttcaaataaaatcgacgtttcttctataacatttgaaaagatttatgagggactttgaactaatatttccctggccttagggagcaaagcatatgccagtagctgctttaatgaaagagagggagggagagagaaggaaaatattattcttttgatttaaaaaatacgttttagctttttaaagtctctgatgcctgagaaaagatactgcttgcagaagtgacatatctactttgaagtacggccatttgtctctctatttccaaatgtaccttagacaattcaagctctctagacagcacttcaggactccagaagagttttccttttaacaaatggtggcaatttgtttctgacattgtaacaaattaattgttacatacccattttgaacattctgctaatgtttatgatacaaaacggcatactgtgattatcaggagagaatttgttttgttctctagtccatacatattttgaaataacattttgatgtaggaaatatttgagaatatggcttaaaattttgtgttatatgaggtcaagggatcaagaccatcctggccaacatggtgaaaccccgtctctactaaaaatacaaaaaattagccaggcatggtggcagacacctgtagtcccagctactcgggaggctgaggcaggagaatcacttgaacccaggaggcagaggttgcagtgaactgagattgcgccactgcactccagcctggtgacagagcgagactccttctaaaaaaaaaaaaaaagttgtgttatacccaatttcggtatgttgtagtaactatgagatagaattttaaaaatatgtgcttcttaaaaaatgtttttttaaatttggaataaatatataaattctaaaaagccagattgcattaaaaatctatcattatgtttttagtaagatggttgtatctgcaaatgtcttagtgagtttctatgaactaaattaaagaaactgtctataagtaattcatgttctctttttaaagagaatttgaattttttaatttctaatttttctttcacaacttgaattcataatcagtatttattttatagttactttagtcacttggttttaaagttatatttttatttttaagaatggcttcaaatgtctcaactgtattttaagtatgctccaattctgttaaaatgatttgtatttaatcgtgtagtggagtgtgctggtagatgatcccatctttgcctttttacactggtgctttgaacaaacctgtttcatacattcctggtttatgtgtgtgtgtcatatggtttaagcattcaccaatttaattgtagtaatgtaaatatttcattatatttttttttcgacagagtcttagtctgtcacccaagctggagtgcagtggcgcaatctcggctcactgcaaccgccgtctcccgggctcaagcgattctcctacctcagcctcccaagtagctgagactacaggtgcccaccattacacccagctattttttgtatttttagtagagatggggtttcaccatgttggccaggcttgtttccaactcctgacctcaactgatcctcccacctcagcctcccaaagtgctgggattacaggtgtgagccaccacacccagtctaatgtaaatatttctttttctagattagtttacaaagttttacttgttcttttattgtttttaaagtaacaatatagtaaaatataaatgaaaatatttttgattagttaattcttgtgtaggggattctgttctcattaaaagccagatcaattcatttcattataaaaagcaaagatacatataaacactaattttataaaaacaaatctacagaatatctggcgtaacataagctattgccatttttgcagctgttatttttgttttaagaaaatttctcaataaccataataatgaaagcatcttaaaattgctgtggtcgtgagggcacatttatgctatactgaattggtgcaattttacaaaattttatatactgtttaaagttaaaaagtgacttcatatgccatgttgcttcactaaataacacataatacttatttagcaacagaaaatgccttatttatgctgaaaactcttggcaattataacagcttttccatgatatccacaagacattagaaaaattataatacattctttatcatattaaccaagaacaaaacatgaagactaaattgtgtaattctcataagtttgagatatttttgtctaatgcagcatattccaactttttcctagaggaccaatcttatcaactggtcctctcttctttaattgtctttaaaaagttgtctatctaagaagaatcaatcttaagtaatgactgtttatcttttattactcatgtctatgtctatatgtggaaatagcattttataccagtgctaccatacaatgttataaaattccaactgcagcaaaaattttggcaatctgtgaagtctcgtcactgtgagtgatgagattaggcagaaaaatgcataattaaaaaataagcttctatgattaaattatggaattgaatggatattatgatcaagagaattctacatgaccaccaatgaataccagattttcactagtcattgttaaatattgaaaataagtagtgttctctttcatggacagtaaagggattctctctaaggaagagatatttaagctgtaagcaggaaggagcctagcatgggaagagcatcagatcatcaaggcagaggaaacaggaagagcgtaaaggctggtttgcaacgaattgaaaggtggccaatgtagctggtgtgcagtgagccaagtgggccgcagtgggaaatgatgctggcgagatcacacacagcatcctagagtagaaggagtgtgtggaaagtataatggtaagttaatgtaaaggaaagttgaggaaagatcttaagcaggaggctgacatactccaggtcatactttgaaataattccttcagttgctgaattgatgttgtgtgagataagataaaatatagacaaatctgtttccatgagacacatatcccaggaattgcattattttggagcaatacttaacaaattattttcaaaatcatggaaaattttattaaatactagtaaataacttgtgatcataaattcctttaagaaaaacactatcttcttttcctgaattagtttgcttaacaggctgattatttttacatttattggcaatgtcttcagcttgccctgtttggaatttaatagttctgaaggtctcagggtcttctgtaactctttctctgttgttgttttgtgtgtttgtgtttttattttgagtttggtggagagtcatactgataatcttcaacattgtgtcattaacaaaacagaagtttagagatgaatacattcaatacaagtccaagtttgccagttactttgttgcattctattgtatgatgtgcacaacaagtttcttcttctacaaatttaagattatagtataatacaggaagacttttgaattacctctccagcaaacctacataaacactctttaccagttactcagaaagaaaaataggctcactttttaaaagagttataggaggaaaacacaaaattgtgtggtagctaaccattcattgcccatatttctcattcttaatcccaaagtagaaaattatcatgattctgatatttctctgcaagctggacatggtggagggtttgaagctaatgaccacttttggatctgtcttagttggttgttgagacatatttttcaactggattatttattcaacaaatattaactgagcacctactacgtgtcagatattgtgctagggcatgggcatacagaaatgaacaaaatacaaattcttttttgttttaatggagttttgctcttattgcccagtctggagtgcagtggtgtgatctcagctcactgcaacctcctcctcccaggttcaagctattctcctgcctcagcctcccacgtagctgtgattacaggcatgtgccaccacacccagctaattttgtatatttagtagagatggggtttctccatgttggtcaggctggtctcaaactcctgacctcaggttatctgcccgccttggcctcccaaagtgctgggattacagtatgagccaccatgcccggacagaaaatacaaattcttgacctcgtagctttcatagtttagtgaagagattcaaaaaaaaaaaaagtcaatagtaagataaacagtacattgcatggtgataagtgttatggaaaaaaagaaagcagtcatttgggtggaaatttcaattttaaaatagatcagcttgtgtcagactaaacatggctgcagattctaccccactcccatttagtcttcaactcttcctcccatcccctctcccagctgaatctgagctgcctgtgattactttgataataaaatgtggcaaaattatgcaagttctcagcagttcgaggcatgctagctgaggtgccgtacgtgcaaggaagaaaccatcctggacatccaacccagtcaagcattcagatgaccgcagacctattcactttctggctgcatctgcgtgaacaatcccgagtgaaagctgcccagctgagaccaataaacccatgaagatgtgggaaattataataaattgctgctttaagctagtacatcttgggaatggcttgtgaggcagcaataaatggcaaacacacacatgaaagaaatgaatgaatgagtattttgagcaaagttttgaagattgtgagagagcaaatcatgtggacatttaggggaggaacatttatgttaattagtccatttattacagagaaaatgagggttttaactggatttccagacattatctgaacaagcagggtatgggatatcaaaaccccacaggtgtatggaattcaagctagttttttttttttttttttcttccagggattgtttttctacatcagaaacgtgtctccacctgactgttcccttaccctaggggcttatgtatcacagtcagaagagtatggttctactcataatagaagcaattaacttctctgccttagggaacaagtttaattaatcaaaacagttttgctaagtcatgttgaccagtacagaatgttctgtaattagtaatatatttcttaaaaaaaaacggtctgaatgttaaatattaatcttaataaacattttcatgatagcattttaaacataaaaatgtcaccattcttctgaaaaattcataataaataggctttcatgtactctggcagtatctactgtcaataaccacttgagaaattgcctgactataattatagctctttcatatgatagctgtggagaccacaccaggcaatgcattgaaagtcttggtgaccaggtatggtggctctcccctataatcccaacactttgggaggctgaggcaggagtatcccttgagtcctggaggtcaaggctgcagtgagctacgatcacaccactgcactccagcctgggcacagactgaaaccctgcctctaaaatataaaaataaaaacaaaaaaataaaaaagtcttgatattgtttctgatgccttggaactgttaaaaaaattcttgttgatatagttataaactgtatatgttgtttaatcattcgttcaaatttcttagagtaattccttatctttgtattaacatgcatatcctggtttatcaaatacttttaaaggattcagggcatctaatgtgattttatagaatactgcgtggcttgcatatcttgtagtatcagaatgaactgaagaacttgataaaaacccacaagattctcaacagaggacatctaaaaatctatttttgacagcacccctggtgattttgatacccatccacaaataggtaactaccaaaaaaattaaaagatattattaaatacaaatatgatagcagaagtttaaattttcacagaaggactaaaagacaaaaaaaaatctatgacaaagtagaacaaacagacaaaagatggaaattggagagaaaagataagcaacttagaagatcagacaaggaaaaccaacaaccgctatcaaaaataatgagattcagcaaaaaatgcagtgaaaatgctcctccattttgtactagaggatacaaaaatgcctttgaacgctgcgaattttttcctgtttaaagatgtttcttttaaaattagtaactgatttgtttaagcagagtattatagccatgactacaatgtttaagataaacacctgtcatttgagtttgtttttggtaatgcctctgtgttcttaatgattcaaatatttactttgactttgtgctctttttaggccaggacatatttaaataagatgttaataaaaatttaacaatatttaaggattatttgagctatattctaaaaggctttaaaaatagggactatcaggcagggctccgtggctcacacctgtaatcccagcactttgggaggctgagacaggcggatcacaaggtcaggagttcaagaccagcctgaccaatatgatgaaaccccgtctctactaaattagccaggtgttgtgatgtgcacctgtagtcccagctaatctggaggctgaggcaggagaatggcttgaaatcgggaggcagaggttgcagtgagccaagatcctgccatcgcattccggcctgggcgacagagtgagactccctcttaaataaaaataaaaataaaaataaaaatagagattatcatgtcattcattaaagggttaactattaaagagtgtgtttgctaaacattttacagtataaagccttcctcagaagcccaattttgaaatatccttactcatctttatggcatgttagactttatgccagggagctttttagtctactattctttggataattttgaactccaagcccacggtcactaattctgatgtgctgatgagcactgcaatcctggctacaccaactggacactaaagatatcacaatattggatgttttcttacgatgtttttgggaatttttctaaaaggtgccagaactttctaattttatttctcactggtatataggctcaaacagagtagagaccatattttttgatcacttctgtatacacagtgtgtagaagaaacaggtgctcaagaaacattctctgaatattaacgtagtgattccgtgcccatgctgctagcataggcatagaaaaaaggagtgagcatgtgaaataaacttattacagtcaggtcttgatttaattgttctcttatttctacccaagggacatgtttccctcagtgttaggataagagaaagtcaggttggcctcactccactaatatttccatagacacaaaaaggtcttaaagctaacttcgaattgttacaagttttcagaaatagtcctctaaataaaagcatttgctttaaatttagttgaaagcacttcttgttccccttctctgatgatgactttttctaagacacttattgtccatgaccccaattgctctagctcttctttattaatttggagcactctgggggcaccacgagccagcatcaggcctcctggctctgccatagtgtggccgcagggcagcaggaggtagtgggggctgtaagagctacaggaagggaggaattcagccccagaagcaaactcagtgagtgctaccaatctacagactcatgcccttaactctaggaaaccgttttatattaattatttggtaatttgctaatcttcattttcactgctttattgatgaatctcattatattcaattgtggtggttgttcttccttgtctgatcttctaagttgtttatcttttctctccaatttccatctttttgttctactttgtcatagatttctttgtgtgtgtgtgtgtctttaaactgtgaaaatgtaaacttctgctatatttccatttaataatagcttttaattttattgcagttgcctatttagagcatctatttattgtaggaaaaaactgttcttgtcacatgaccaggaaagattaggcttgcagacacatataagggtgatgagtggaattcattgagcgaaaaggaaaaaggaaatacaactcagcaaagtgagatggagtcctgctaacaggctctctacttcaccaactgaatcccagattactacacagggacagaagaggccagcctccccaccccccacccaaactagcgagaacttctccaggcccaactccatcctccgaatgcacaagacagctggggattctctggggagcccttttaacttggctgtctcaaattcctattttaggtaaaaagaaatacatccattttgtttagaatgcaatatattttgtaatattctaaataaatatataaatatatacatacatatatgtatttatatatacaagtatataaatatattatatttatatatacatgtatgtatgtgtgtgtatatatatatatatatatatatatatatatatatatatatatatatatttggtgtgccagtgtgccctttttaaactctcttcagctgcctgctttatcttttatttcttggaatttcttttttgcttatttatttctgtttctgtcttccaagttggaggcattcctcaaatacctagtggttgtctctttctaattaagagtgaattaccagtagtatggtagattaaatagcaagaaaaccttttttgttcccaaacaattgaagttttgaaacaaatatgcttgtgtatttaaaatatgctcatttaaaatataggtacaattaaaatataattacttatatatgtacacatgtatgtacacattgatgtactgtcaagagagtatgcagaaccctcagaagccaacaataaagttaaaggagaagttcagggagctaagcaagaaagcactgcagacagcagcagggcctgggtcgttttcatattcctggtctccttgggcttcacattgggtgtcctggtaatacaggttaggaaacagagctgagttcagcctgagactggaggtcaagttggaacacacagcataagggtcaggactctaaaggactctgtgaaaggctgagacaggaaaacaaaattaaacaaagcaaaaaattacagaacaataatagtaacaaaagttgtgtgtaaggcagaaaggaaaatttacatcttttataccttgagtgagttgagggggaaaatatgtctcctgagaatttggtaccacaagccagctctcctgtgagttggtgatgaaaatttctgctactttcagaaaccgaaaaactcaagtcttggatttaatttaaaggaagtcactataaatttcagaggattggcatcctatagaccatattccctaacaataatgcaataaatatacaaacagataacatacagaagatttaaaaagctttcatatttgaaaacgaaaataaataatccaagaaaaaaacgacttatatgtcaaaaagagatctcaataaactttagagaatacttaaaactgaacaagaatgaaaagtttgcatatcagaacttgtggaattcactcaaatcagaattagaaggtaactttatagggttaaatacttttattagagaaaagtccaaagagcaatgagctcagcatccatctttccacattaaaacattagaacatatataggaaaatttacccaaagaaaataaaaataaagaaaaaaattaatctaaaaatagaaattaatgaaacaaaataatcataccaaaaaaagcttatttgaaaagaataataatgttggaaaaccttcagctttacttattatgatagtcattagtgctgtttgctaagttttgtggctccctgtcttctggaaacatagcagagttgcactttttggtctttgtgtttgaaggggaggcaagtgactctttctacccattaggctggtgtagaaatggcatgtactacctagagtctagaatactagattgccaaagtgagatttccctggtgttttttattctgatatcatgactagcagtgttcaagatggttttcctttatcaacctgagcttctgaatggctataatgggaagagatccccactatgaagctgggaaggaaatattctagacttattgaaaaataaaatgtgatgttttaagtcattgaatttttttttttttttttttttgagatggagtcttgctctgtcacccaggctggagtgcaatggcatgatctcggctcactgaaacttccacctcccgggttcaagcgattctcctgcctcagcctcctgagtagctgggattacaagtgagcgccaccacgctcggctaatttttgtatttttagcagagatggggtttcaccatgttggccaggctggtctggaacgcctgacctcatgatccactcacgtcggcctcctaaagttctgggattacaggcttgagccaccgtgaccagcctgtttattttaatagcaaacaaagagtgtaaaacataggttgtcctggccaatgctctttaagaagagagaaaggaagaaaagaaagacagacagagagagagagggaaagagagagagagaggcccacgtagagagagagagagagacagagagagaaagggggcagagggaggaaaagggaaagaaaaaaggaggagagaggaggagaagagggaggaaggaaagaaggaatgaaataaaaaaggaagaattaaaatcactggagaagaccaaaggaaatacgttcagatgacgaacgcattaaaaatattatttaaaatgttatatacaacttaatgagaaaatgaatatattttattaagtttacgtatgcttacagaaattgaatttagcaaacagatttaagaagaaatagaatacttgaatcactctataaacatcagcgtattagatcagtagtttaaattcttcccataaagtacacaagtggactggatagttttactggttgttctaccaaatatttactgtgcaggtaattacaactttatgcagactctcccagggcattgaaaaaggggatcactttacaaggctggtataaacttcactagaaaacaagaaagcaaaaatttgttgtcaaagacattcattaacatattgatgtccctataccttcacctattatattttaacctctcctgtgttcctttgtctctatctcaatctattttggcaccactggtctcttaaattttccttagatactctagacacatacctgcctcaaggcattgacatttagtttccctctgtttgaaaccttctcccaggagttcgagaccagccaggacagcatagtgaaaccccatctctactaaaagtacaaaaatttagctgggtgtggtggcgggcagctgtaataccagctactagggaggctgaggcaggagaatcgcttgaacccaggaggcggaggttgcagtgagccaagattgcgtcattgcactccagcctgggcaacaagagcgaaactccatctcaaataaataaataaataaataaataaataaataaataaaataaaccttctcccagatagcctcttggatgatccctttacctcctccagaccatttcacaaatgtcatcacagttattccttccctggtctctttatcagaaattgaaactgatattccagtactccttaccccacctctttgtttagatttccttccttgaacttttcacaatctcacctatatttcttcagtatcttgtttataatcttgcttgcacctctacaatgaaagcagagattttcattgattttgtttacttctaaggtctcagcaattagcatagtgtctgacacctggcaagggctcaataactgttggatacattgataaatgcaaaagtattgaacaaagttagcatgacaaatttagtgatgtatttttaaaaacccagtgacaccattttttttctcatgaatgcaagtttcacttacattagaaaaatttattgaaatggtagataaaaagaagaaaaaaaattattttaccagatgggaagcatatgatagaatttaaaacaagagaccatctttaaccaataaaacaaccgcaagcatcaaacttaatggtaaaagcataagtatcaggtaaaagcataagtatcgataatatcaggatcacaaaagataccttttcgcattacttttaatttcctctctgtattttatccaatagcgtaagacaataagaagataaagtaaaaggcacatatattgaaaaaaaaagaaataaagcccaaaattttcacaggtggtatgattatcaacttaaatttaaaataatccacaaactcaaaataattcacagaatcaatgaaagaattttaaagtttgtggataaaaaattaatatctaaattacataaataatttatacaaatgcaaaaagaccaatcagaatcccaatgagttaatttgtgtaatcagacaaactgtttttaaaattgattggtaaagtagaagggcaatgaatagccatgacattcatgaagaaaatgcattggctgaggcaatttcctccacaaatcaaaacatactataaggcagtgtggtattggcccaactgttactggaaaggggtccccatccagaccccaagagagggttcttggaacttgagcaagaagaagttcagggcaagcccatagagcaaggtgaaaggaagtttattaagaaagtaaagggataaagaatggctattccatagacagagcagcagcttgagctgctttaccaaggattcttactgttacttcttgattatatgctaaacaaggagtggataattcatgagtttttggggaaaggggggagcaatttttggaactgatggttcctcccctttttagaccatgtagggtaacctcatgactttgccatggcatttgtaaactgtcatagcactggtgggagtgccttatagcatgctaatgcattataattagcatataatgacccatgaggatgaccagaggtcactctagttgcaatcttggtttttgggttttagctggcttctttactacaccctgttttatcagcaaggtcttcatgacctgtatcttatgctgacctactctctcatcctgtgacttagaatacctaacccactgcatatgcagcccagcaggtctcagccttatttcacccagcccctattcaagatggagttgctttggtttaaacacctctgacacagtgatagacagactaatgggacagaatagacagccctcaaacagacctatacctctctggacacttgataatgacaaaaatgacgtaggtcaggagaagagcaatcagccgcctggtaaataatattaggaaaaatttatcaatgagtcaattgtcagtctattgtaaatctcacttctcaacctctcctgtcaatcacttttccagaatccacaattttgttggcctctcttctttgttgtctgtctctcctggtctttttcttattggtttaggttcttttccctttatttgttttgatgcagtttgtggagtgagcaaaagcaaaggcatgtatttgacttcacaatgtttaaatggaaataaattaatcaatgtctttttaaaaatgtcagtatctttttttaaagataacatatcttcacagcttctattttctttttctatttcttctattttctttttctatttcttctattttctttgaaattttgaagttatttcttgtattagtacaagtcaatctataacttcactaatctttgggcaaatgctaatgtttcagagggtgtgttgaacatctcataattcttttaatatttgttttcatgttaaagctgaaggcacagtattatttcattttggaaagtataaccagaaaatggatgtgagaaatacctctttgtgtatataggtagtgactagaacatgtaaattcagtattccctatttgagccatctgttctatttgagaattaatgggcctatttttattataatatctagtattgaaaatgtttcctgttcaaagtaatctttatcattttactggagagtttctcaagaaaaaaatatcttctccagcaccagcactccacttcctatgccttcactaatattcatttaatacagtggcttttcatttgcagttcagtgaaaacgtggtactgggggcagcaagatccgcagccttaaagggtgattgttgggaacctatccggggcccaggggcagggttgctatgacaactctgctgctctgccaaggctgttcctctctgtgggtggaaagaagctcccctgccagcaactacgtgggatcctggcagctggagagaatactgaaataatgcgctgcttccccagatgggagttctgagagtcttcttttaaaacgaataggcaactcgggctctgtggaagagtggggatagttaggatctagcccgttacaagtgcgaaatgtgtgtgatgaaatacttaaggtttcttcctttgaatagaagtttgacggatgatcaggtcttaagtcaaaagattttagcttaacttcacagtagtgcaagtttagaggaatttgtatttgccataaaggtaatatgattctgagagatttaaataatactgtttacatagagtaaaaagaccttacactcatttggaaatgcacgttatctcagagttgtcaatttgggttgacccaattttggaatttatctcgggcttttctttctaaatttgaaagccactactcagttgaatttatacttgatgctctgatgcagaactccagtatcccccttgcagctgtagagcatagtgtggaggctagaactggtccatttaaagtagagtggagaaaatgagaaataagtgaaaccgaccctgaattaatacttaaattaatcagaagtccccagaagtggttttggtgatcagtcatgagcttaccactttatctgctcctgagctatcctgattctgattttgtctttgctcagttattaactttaggctctaggatccagcaaaggcaattcccacctatgcattcagtgtttgaactcttcatatatgaacttattctaccttgaacagttttgtgaaacatgttcatctatctggttttcatacttctgattgtctgcagtagaaatctcccacaaccacatcaaatccttcgagaacagtgaaagacagaaatcacagatgaataggatttaaaatcatgaggctatgtggtatacttgccaaaaatagggatagctctacattgggctggcactaatttttttatgattattatttttaaataatcagtgaggtggaaattgtagaacatcaagagacagaatagttgaaagatttttctgctgccctgttaatctccacccaaaactgtgttcagtgacattcagacactacacacattgtttttagccatctgctggtgaaatctcttcctattacatgaaatttcaagctgttctaaccttttctacttccccacattgtgtgtgtgtggggtgggggggcgtgcacacgtgcacgtgtgtgtgtgtgtgtgagagaaagagagagatgtgtgttgggggaggaatgttcaagaaacaattttgcctgcacaaacaacagctactgaagtgggaaggtgttcagactcctttttttaacctcctctggggcagatgggatggactagaattgtcaagaaggccagttcagtgagcagcattaaaaatagcagactagctcaatctctcaatataaacttagttctcacaggaactttgcaattatcacatgcttcatatgttgctatatgcatctatgccttctagataaagtgcacacagatcttcctatgacttaagcacaataataatccattttaaaatcttgtttgtcatttgtttctgaagaaaaaggaaaagtcattatctgaggggcttcagcattacaaagacagatttgatcaaggattttcataaggaggaaatctttggaatgaggatatgtgtgtgtatctgaggggtggggtggctagaggtgggtacatatggaacctaggtcatccttgcaagtacccttagcctgtcagctctctcatctaaattctcctttatcagctgtggctggcacatagtgcctcaccagtatttgctcttgcaaaacatatatacttaagcatttctagttaatttcttagaagatatctagcaatagcctaggaaattgtgacctttattttgaatatttaccatcattttctgatgtctcagtttaaatgcttaaagctgtgttttaataagtaaaagtgatgagacttcaaaaaccaaaagtgaccatgatggccaaagaatttttgacaaccacatgacagcacagtaatagttcatatgaataatagttaaattaggctgggcgtggtggctcatgcttataatcccagcactttgggaggctagggtggatggatcacttgaggtcaaggtttgagatcagcctggccaacatggcaaaaccccgtctctactaaaaatacaaaaaatagccaggtgtggtgacgtgcgccagtagtcccagctactcgggaggctgaggcaggagaatcacttaaacccaggaggcagaggttgcagtgagccgagatcgcactactgtagtccagcctgggtgacagagtgagactccatcttccacccacccccaaaagtaataatagttaggttacatctaataatgacagataacatgtagtgagtagttactctatgtcaagcactatttttttatattaactcatttaatgctcatgagaaccatatgagagattatcttattgtcacatttttaaagacaataagctcaaaagaataaatttggcaaaaaccacacagggattggtgtgtccaatgtgctctcatttgctgtgccagtgtctttctcattttttcaaaccatgaatgatagcaagaagtagattttcattatgagtcaccactcaaatatcatataggagtactgaagtcaaaagagtcaaaaataatttcccttactacataacatgaattcagatattgtctcttccagtctctgtcacttttaatatttgctggtcaaagttcactgagttttgaggtcaagagttcgagaccagcctgaccaatatggtgaaaccctgtctctactaaaaatacaaaaaaattaatggggcacggaggtgtgtgcctgtagctctagctacttgggaggctaaggcaggagaatctcttgaactcgggaggcagagattgcagtgagccgagattgttccgctgcactccaacctgggcaacagagccagactctgtctcaataaaggaaagaaaacagttcactaggttaacttcacaacatactaacaggcttcaacttactgtctgaaaaattggttaatgggtacaaaaacacacttacgtaaaaagaataagttctagtattcgatagcatagtagggaaattatagttaaaaatagtctattgtatatttcaaaatagctagaagagaagaatcttaatgttccgacacaaagaaaacataaatattttaggcggtggatatcccaattaccccgattttatcctcatacattataaacatgtatccaaatatctcctggatccccaaaacttgtataactatgacacatcaataaaaatatctgttacaaaaaaagaaaaatgcagatacacagagtgcaaaagaataaataccattgaaataaaaccataagcatgtgacatttgggagcaataaattcaagatggaatgatatgcatgcatgtatggtgaagattaattattatagaaagtctgggttgggaaggaagggcttctctaggttttgcggtagatgaggaagacatcagtcatggcaaacattctcttatttgtggaggatgggtttataattaaggaatttgatcttagtatccttcaatgcactctaggacttcatttgtatggttgacctggtattgtcagtgcaaatatactttcccatagtgctgaagtttgaaaaaaaaaattaaattaggttaacaaaaatatgaatttctccctttgtgatcttctacagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgtaagtcactctagtatttcttgttattttccatgtatatatttacacttctatgtgttaaatgattaggggcctacagttagatgaggtgataatatatatgaaacagcacttttagggtatacctgattcaaaagggtaatcatgattcatgattgccttcacagtcaatagaaggcacgtagcacaggatcagaggccgacttaatcaggacttaaccaatgctttaaatgtaaagttgtattcgaaatttggttaccattaagtggaattctgggacttcccttgctcttctcatttgaacagaggctgttctattagaatagtgccaggtacaaatctggcccttgctactaattttaggaaaatcagcaaagctccatgggtgctcccacctttaaaagaaataaactcagccctgggtatggtatcttactgttgctgttacatttacagaaatgatgtaaatattgtgcaaagttcttattgtcttctgtaaaagagtaaatcataagaaatcaagcaaccttttttttcaaacaccaattatacttttctctcataaaatgtaaaactcctaagatcactatgattatgttaaaataacttttttagaaaagtaacttaaacagtctgaaaattaaagtttgctgttgaaatttcagctccttattgcataatatagagaacaaaggtttgggattgaattctagaaacgtttattgctaaataagttactaattcagataatttattcagtgatttttatgcccatgaaaagaaaataatttattagtttgtttgtaatcccagctgataataaacttgtctcctgagcccttatagcttttgttatatttataacttcttgtgtttatttcatgctgtttgatacctgtgtttgtaatcttcttcatgttcctttattttgtcattctaaataaactcaaacattcttaatgtatatacatttttaactaatatgatgcttttagatttacaaatctgagtgagtatctggatggttagtgtagctttgctttttaatcttatcattccatctaagagaggttgatcacaattctcatttatgcagggcaattcctgttgaactggtataattttaacctaagatcctactctgaaaaaacacttggtcaacccagacaactttttaggtagaagacaacttttctccaactacaatatcaggaatatatcatattgctaaatttcttatactccatcaggtttaggcagattatcttgaacaaggtatttttcaaagtaattttcataaattgtttttcataaaagtatatttcaaagtattttttataaatatcataatttttttttatttattaaagttactaatttcccctgaaaatgaaaagagaatagagttgtgggccgggtgtggtggctcatgcctgtaatcccagcactttgggaggctgaggtaggcagatcacttgaggccaggagttcgagaccagcctaagcaacatggtgaaatcccgtctctactaaaaatgcaaaaattacctgggcatggtggcacaagcctgtaatcccagctactagggagactgaggtatgagaatcgcttgagcccagaaggcagctccagccttcgcaacagagtgaaactctctctcaaaaaataaaaatttaaaaaaatgagaatagagttatacatttctatcaggtaacagagcaagaatgctctgttttggggggtgggtggacaacatatacccctggacagagtacatagcaaaatttttagtaaaagcaaagctgaaatatttgtttatttaaaacctgttgatacttaaaacctagagaaagactgataagaaaataagaaataaaatgaggaaaatgagattgagaaaacccagtcccctccaccccccacacatacatggggattagaagaatggaactgattagctactaaattaagaagtgaaattattataaaaatatagtccataactctgtagtatcaagtgagagcttcgctaaggtcatgacaaatgggaatgaagaattaacagcaaattgaaagttgcatattatatttcccaatgtaaatttattttactaattagttctgaaaaattgacgttatccattaaattgaatcctttaagcattagtagacagtttatcagttttcatcaaactaaatacaaacctatgtataaaaccaaaattcaatagctatcaatgccttagattcaaatagcatgaatcaaccctttaaagattataagtcatattcatcatttggaatataattaaaatgctctagattattgcaggttagcttttagagagtcttaagaaaatgattgcatggatatattttaatgtgataaaactgacattttctagatttatctcagcctaccctggacaaaatatgttctcactgtgcattattttaaaccatcacagatgtccttaacatctacagattctctctatgtaaactacatccaaattgctaaatttacttatagaattacaagtttgtaagaaatcataagcctaatgaatggcaatagatgcttatgtacatctatcagcaattatttgttaagatatttgatatttaaacaacaaactttcatatattgtagagatctactaaagctctaaaggcagtgtatgtaggggtgaggggagtttagaagaaagattggagattatatgcttaatttggtagttttacctttgctctgttatattatgtattaaatgtgaaaccaataatgcatgtttggaatgggaagaataccattttgattggaataaaagtaaatgtcaaaattatctctgttttcatatttcacattactaaaattccttatacaggccctgcagagctaacaaagtatttgagactctctccctaccaacaaatagttcatgaaaacacagagggaaaatatgtactgtaaacctcttaatacgattagtgccaagtgataaatttaaagattacataaaggtttcgaggaggtagatattacgctatgcagggctgccttacggggtatcagaggaatggaaaaagtgctgaggaaacagaagatgtaaaataagcaaacagaaggcagaggaggctgaatgattcgtttgcaggccatacatctccttggaaatcaactaaggtaggtttggaaaagaatgtataagagcataattgtggagaaaagacttacctaattttagtaatttacagagtctatttcttttctccatagttctcatacttagttcaaccaaattcatcactcctacattatatacttggaaaagaagcttgtttactggatgtgtgaactaaaagataaaaccagttccagttgcccaagccctgaatcttccatctgtggtgctcaggatttgaggagttacctacttctttatctcagggaccacaaaatttctctctccctctcttttcctctctccactatctcccttctcttaaatacatacacttatctcaacatgatcaatatttccaagtccagagggagacatgaaaggcaacagcaaacgcaatgacgtgtgactattcggtttcactaatcacttgtccagaatgcaaaccatactgaccataaatgagcttgcaaataatcctcattcttatgtaatctgtattttagacatataattctaaatactatcagcccctgccagtgggagctggcctgaagttgagctcctaaactcttagctgatatcacccattatactgttttgtcccattacatttgaggtgtggcaacctccagagagagagaagaatgtatttctcaaagaatttctcaaagattttgttactcatttatataactcatttatagtcatttgtataacttttagtacttctctgtctcttgtctattttcttccccagaagcttttaatcccttaattttcagcttagtttctcaaagccaggtcatttgttagttccaaactgttttgataagaagtgtgcaacttcttatccattaggagttatttctacactctaatcacaacttctgttggtttagcattgccatttaggcccactcagcactcaaaacagctctgccgctttctgctatgtgatgaggaggacatttttttcatcagaaaaattgtgattcagactttctcttgagagacatttggaaaggtgttattactgtgcttcataagtcatttgacaaactaagtaagaagtagggtaggtattttgcttctgtgaagcagattcatttgggacaataaaatatggagactgttagaaaattagatatcatacagaaatccaaaccactaattttgctaagtgacttggctttttgaatagctctccaaaggactgggcaaggaacagtcttactcataagcatgccctcctgtagcttataagataaagactgtatttgggtggtcttctagagtgaatattttattttcaaaattttattaattttttaatgactgtaatttcaagttaacacatcaaaaactgagttcactacctagtgaattctttaatattgcatgcacatataaaatagttcctatttacctaaaacaaaataaatcagtaagctcagacaaaatagatatatagattttgttctcaactaacttcgggtgggtttatatctctaagtttgcttgtagtttacgtttactccttggaagttaatgaagtaggaaacagttgttagcagcttaatggatgagtgtaagaagggaaaactgtgaattaatagcaagaaaaaacaaagtttcataggctaacatgaatcacagtactgtgtaaactgcctgtactgaactaggttgttgacaattaaacctaattgctgaagaattctactccaacaatggttgaagatctgccaaatttgtattgatgtatgattattgattattcttggggagtcaaacataatgtaagtcataactagaactcatgttagaaaaccatactgaattcctaacttttgaaataataaatagtgtgcatttcattaggcaatatttcagccaggttagtactcctcaaatgggtgtttttaaaaacctcaaaacaccaatatgaaataacaacaagaacaaaaccaaatacttgaaccatgaggaatttagatagacaagatagtgtggtgaataagattttggagtcaaactcccctgagcttgttccatattgtctctgcttctttccagctttcttaccttggaaaagttacttaacctctttgccttagtaactaatcagtaaaagggatgtattaatgctgcttacattctagagttgtatgacaataaaattagttgataattagttgatatttcaaaacaataataacatggctggcacagagtaagcactatacaagtgtttattattatgatgtgatagtgggggtgatagtggttatgataataatgacatctactctgaaactgactcacagttttaatacctactttcatgctgccttaagtctgtttgtccctgaacataccctaaacaaccagttattgtgaattatctcacaacaactcactcactcactatctccagagcagcactgaggagatggtgctaaaccattcatgagaaaccacccctatgatccaatcacttcccaccagtccccacaatggggattataattgaacatgagatttgagtggggaccagatccaaatcatatcattctgccctaggcctctcccaaatctcatgtccttctcaagttgccaaatacaattatgtttcccctaagttcccccaaattcttaattcattccagtattaattcaaaaatccaaagtccaaagtctcatctgagatgaggccagttcctttcacctatgagcctataaaataaaaaacaagtcagttactcccaagatacaattgagttacaggcattgggtaaatactccaatttcaaaagggagaaaagctgaaagaaaggggctataagcccccatgcaagtccaaaatctagcagggtagtcattaaatattaaagctccataataatttcctttgacttcgtgtctcacatcttgggcacactgcaaaggttgggcccccccaggctttgggaagctttacccctgtgacttttcagggttcagtccttgtggctgttctcatgggctgctgttgaatgcctatggcttttccaggcacaaaagacaagctggtggtggatctaccattctggggtctagaggatggtagccctctttcacagctctactagctagtaccccaatggggactctgtgtgggagctccaacctcacatttcccctccatagtgctctagtagaggttctctgtgagagctccaactctgaagcaggcttatgcctggacatctaggcttttctgcatatcttctgaaatctaggcagaggcttccaaacctcaactcttgccctctgctcccctgcaggcttaacactacaaggaaagctgccaaggcttatggtttgcaccctctgaagcagtggcccgagttgtatacttgggggtcttttagccatggctggagtgggagtagctgggatgcaggaagcagtgtcctgaggctgtgcagagtagcatggacctcaggccaggcccttgaaaccattctttcctcctacacctctgggcctgtgatgggaggggctgccacaaaggtctctgaaatgcctttgaggcctattccccattgtcttggatattagcacttggcttctttttacttatgtaaatttctgcagcctgcttgaattccaccactgaaaatgggcttttcttttctaccacatggctaggctgagaatgtttcacttgtatgctctgcttcccctttaaatataagttccatttttatgtcctttctttggttgtgaatatgaacacaagcttgttagaaacagccaggtcacatcttgaatgctttgatgcttagaaatttcttccactagataccttaaatcatctagatctctagagcagagacataatgtggccaacctctttgctaatgcataacaaaagtgacctttgctccagttcccagtaagttccttctttccatctaagaactcctcagcctagacttcactgtacataatcactatcagcattttggtcacaacaatttaacaggtgtctagaaagttccaaactttccctcatcttcctgccttcttctgagccctccaaactgttacaggctctgcctactacccagttccaaagaggtttccacattttcaggtatctttatagcaatgccccactctttggtaccagttttctgtattagtccattctcacactgctataaagaaatagttgaaactgggtaatttagaaagaagaggttaattgactcacagttctgcaggctgtacataaagcatgatgctggcatctgcttggcttctagggaggcctcaggaaactcacaattatggtggaaggcaaaagggaaacaggcctatcttacacggccagagcaggagcaagagagagtagggggaggtgctgcacactttcaacaaccacatctcaccgtaactcactcactcactttcacaagaatagcactgaggggatagtgctaaaccattcatgagaaactgcccctatgatccaaccacctcccaccaggctccacctctgacattcgggattacaattaaacattagatttgggtggggacacagatataaaccatatcatagcaactttagggaaacatatctataaataagaacacgatagtttcattccaataatatttgaacagttatcagatagaagaaaacttgctttgttctttatggttcagagagaaagagacttaagccgaagtatttcaatttatagagaaatactttcttggcatcatataaagaactttccaaaaatcttttcaaaaaagaatacatagactaccttgaaatgaggtgatttgcttatcaattaaagtgtttagggaaggatggtaatgaacttgtagttctgaaatgcttacagtctgtaattcacttagtcttgttaactcaagaatagctatcttagtaatagttcatgtttcacaaattgagcaatcatgaatttcaagtatgaaaatatattttaaaatatttgtatttattatacttctataatactcctgtttccaaatatatatatacttatatatgtatattttatatatatatgtatatatgtatgcatatgtgtatatatatatatttaggctaatcttatgtctgattaatcttttaatgaatgtactcattcagaaaaaaacttaggtgatactacgtgccactcactgtgctcatctttagaaatgcatagcagagcaagacaaattccttgtcttcgagcactgaaatatgaaaggtatgtgagaaaagtgccatccacatcagctaatcagatacaaataaagaatggtagagctagtactttaacagagttataggtttcatcaagctaaacaaatacagggaattgagaagctgcggtaattaatattatactatatggtattttgcagagacatagaaaaatatataaaatggagcagaatataaaggtaaaaagagacccaagtccatgtaagtactcataaatacacatgaaactatgttcctactttatattttaccaaaatttttcaggtgcattaaaaattagaatttaaaggtaagctaatttgtaaaagctagacaaatacataaattagggttttctttatcatggggtaagaaggatacaagcaatatagtaaatcacaaaagaaaatatttatgtatttgacatactataaattaaaattgtattcattgaagtgttataaaaacattaaaatgtatttaaaaaaactgagaaaaatatttgcagcttacatgaaaagagctcctaattttataaaagaaaaattgctacatctacagcaaaatgtgtcactaaaaacagggaaaatataaaaacaggtatactaaaaactacaaaagcttaatagcttgtaagcatatgttcatcctcactagtaaactcagaaaagtaattttaaatgataccattatttataacctatcaatttatcagaaaaaaataaattataatacctagcattagggaacaaagagagagtaagacctttgctttttattaatgcatcttcattttggcacaaactttctggacaccattttgaccatatgtacattaatttttttctaggaatttatcccagggaagaaatctagactgagaacaaatattacataatattatcattattgccatgctgtttttaataacaagttctagcttaccattgctgctgcaaaaaagaattaccacaaatatggttacttaaaacaaaatgtattatcttagagtcctggaggtcacaagtatgaaatgggtcttactgggctaactgaaatgagctaaaatcaaggtgttggcagaattgtgctccatctggaggctctcaggaagaagccgtactcttgcttgtcctggcttccagaggccacctgcatcccttggctcatggtccctgtccatcttcaaagccagcagtgtggcatcttcaaatctcactctgaacttgaccctgtctctctcgcctctctcttttacttttaaggattcttgtgattacaatggggctacccagataatccagggtaatctcctcacctcaatatcattaatttaatcacatctccaaatcctttttggcatatgagatgacatatttacaggttatggagataatgatgtgagcatcactggggcccttcagtcttcctaccactgaacaaaagtagacaattggtaaaatcgatcatgatatcttcaagtgacagaatgtgtcatatcctaaacattgtttaaaaaggtatataatagtttaaaatattcataatatattgatttaaaaggaagttttcaaagtggtatatagtaagcatagctttgtggaattaattaaaataaattaaaaactggtagtataaacagtgaataatctgcatttttcttatatgctttttaaaaaaatttacaatgcttatatattgcttttacaattagtaaaacagttgtgtaacaaagtctgaaagtctacatttaggaaggaggtaaagtaagtgaattaatcccttaagaagtaggataatatggatgattgttttggaaggcaaaagtagtgaatgtaaaacttcttcgctatttctctatttgatccttctgtgacttcataatcagtgacttcttcgtcagaggattatttatgcatcttgtgatatatcactgacaaaaattcatcctcacgtagataagtaagagtttaattttcctaatttaatatttgaagttatgtattctattaactttatatattgcatgttgataaaaggacacttttgtgacaaagaagagaattaagtcagtaagatacctcaggtttattataatttaaatgtttgatgatttaaaattttgaaatggattttggaatgtaacattagcacatgtccatcaccacattgtttgaagaaaaactttacctaagaatatttgaaggtcaaggaattagcattcaacttcaatgaagtctatagcttgtgacaggctgataatggccctcaatattataatccttgtaacatcatatgttaccttttatggcaaaacagactttgaagttgtgattacattcagaatcctgaggtgagcagatcctcctggattatctggatgagccccaaatccccacacaagtgtccttatgagaggggaacagagagccacttgaccagagaagaaggcagtgttacttctaaaacaagatgctacctgctggctttgaagaaggagaagaggccactagccaaggaaagcccagaatggagtactctgaaagtcggaaagtgcaagggaagtttctccaagtctttagagggagtagggctctgccaataccttgatgtcagcccagtgaaactgatttcaaacttctgacctccagaacataagaatgcgtcttttttaaaaagccaccaagtttgtggtaatttgataaaacagtcataggaaattaacacataacttaggctaatttattgcagcatttcctgccaggtatttttacagagtgtttgagttaaagtttgaaaagataaaatcaaaaggtttatatttgctataattgccaccaataatttacaattatacttctagcatagatgccacaccttgcagtctcatatgtttcaattgaacgaaatatgaatttgagataagtgatgtcagcaagttggtggactggtatgtcccagcccttgtcccccataaaacatcaattcaacagtaatttacagaccaatacctttatgagatttccagaatccccttaagagtttgcagtactccaggtgagcacaaagcccgtaacagccatgttgaaacaggggacaagagcaatcttatttatcccacatcagcccctcttccaagctagctcacctcagcactgggagaaaaagagaccagaagggtagaacacacacccagtgctctggctttttggagggttggttgagggactggtttctgtctcacctcattctaagcagtgacagaactagcctagtgtagatacctggcggcttctgagaacatctcagtgaaattgggagaagcctcacaaacattgttctgcaaacactgacagacccgaagggagaaattaacagtgacacaatcatagtaggagatttcaatacctcactttcaagaatggatagaatatccagacaggtaacagagacttgaattacaccatagaacaatggcataacagcatgtacagaacatgccacccagtggagtagagtacatattctttccaagtgcagctggaacattcaccaggaaatatcacatcagctcataaaacaaggcttaaaaaatttaagagggttgaacttatatttctacaactccatttacaatagcttcaaaaagaaaaaaaaaaacgctataaataaacttaaccaaggagggaaaaggcttgtacactggaaattgtaaaacattcttgaaagaaattaaagaagacacaaatagatggaaagacttcccatataatgcactgaaaaacttaatattgttaaaatgttcttatgaaccaaggcaatttgtggattaaagctatatttatcaaaatcacaatggtatattttgcagaaatagagtaaatcctaaaattcttatggaatcacaaagggctccaaatagtcaaaacaatcttgagaaagaagaataaaagtgaaacttcacacttcttcactgcaaaacattataaattgacagtaatcaaaacaatcttggccaggcattgtggctcatgactgtaatcccagtgcgttcgtaatccctatctctacaaaaaaagtagaataattagccaggcatggtggtgcctgcctgtagtccaagctgctcaggaggctgagactggaggatctcttgagcccagaggtttgaggctgtggtgagctatgattgcaccgctacacttcagcctaggtgacagagtgacaccctgtctctaaaaaacaaaccaacaaacaaaaaacagaaaataacaaaaaccaacagtttgatatgtatgtatatatgtatgtatgtatttattggtacataattacacgtatttgtggggcacatgtggtattttgatataggcttacaatgtgtaatgatctaatcagggtaattaggatacccattgcctcaaatttttatcatttctttgttctggagatgtttcaaatattcttttctagctatcttgaaataaattatttttaactatagtcactctactgtgctgttgaaccctagagtctggtattgacataaagacagacacataaaccaccatagcacagtagacaacccagaaataaactcaagcatatactatcaccgaattttcaccaagaagacacaatgacaaataggtagtctcttcaataaaggatgctggaaaaaccggatctccacatgcaatatgatgaaattgaatgcttatattacaccacacacaaaaataaactcaaaatgaattaaactttaaatgtaagacctaaaattataaaactgctagaagaaaacataggagaaaagttcatacctttgatcttggtgatgatttcttggatatgacacaaaagtcataggtcacaaaagcaaaaataatagacaagtgtgactagatggagctgaaaagcttctgtgcagaaaaggaaacagtcaacagagtgaaagggcagcctacagaatgagataaaatatttacaaactgtttatctggtaaggaattaatatccaaaaaatataagtaactcctacaactcaatagcaaaaaaacaaaaacaaaaatacccaattaaaaaataggcaaatgaggacttgaataggtatttctccaaagaagacttacaattggccaacaggtatatgaaaagatgttccaaatcactaaccatctgggaagtgcaaatcaaaaccataatgagctgtcacctcgcacttataaggatgcccattacaaacaacaaaataagacagaaaataacaagtgtgggtgagtatgggaataaatttgaaccctagtgttcactgatgctaagaatgtaaaattgggcagccactatggaaaacagtttggcagttccttggaaaattaaaattagcaatgctatgtgatccagcaatcccatttccgggtattaatacaaaagagttcatatcaggatcttgaagagatacatatactctcaagtttactgcagcataattcacagtattcaagatgtggaaacagacaaaatgtacatggatagatgaatgcataaagaaaatacagtatatacatacagtgtaatcttatttggccacaaaaaaggaggaaatcctgtcattgtgatactagatggaagaagttcaaggacattacactaagtaaaataagccagtcacagaaggatagtgctgcacaattttatttatatgaactatctaaaatggtcaaaattatagaagcagaagatagaatggtggttgtcagggctgtggcctggggaatatggggagtggctgttcaatgagtgtggagtttcagtcttgtaagatgaaaacgtttgaatgatctgctataccacgttgtgcttatacttgacaatgctgtattgtacacttaaaaatatgttaagagagtaaatcccatattctgtgttatttactgcaataaaaaataatgaaacatgactttcctttaccacaaccctaaacattctaaagtagcttcaatatagcctgcaaaattgcagatactctgttctgaagtctggtagagaagcaactggaaacatcaacttcaatatatctatacactagactagaaaagctactcatttttactcaggaatgtttggttttcagtgcttaggaagaagcaggcatttcttactttttaaaattgccattttccagctctaaagaaatattgcatactctagcaacttgtgtgtcaaaccactgtgttctaataaatgacttgtagcatacaagtgcattagacaatgtcagaatttgtttcaagcaatctttacatacagaacaaaaagatgtaataattaattagtcaactatattagttcactgtgactgccataacatatagccacaaactgttggcttaaaacagcagaaatgtattctctcatagttggagaggccagacacctgaagtcaaggcgtcagcaagggtggcctcttcccggagattggtaggggaaattctgctccttgcttgttcctgactctggtggttgcgggccttccttggcttgaggccacagcactctaatctctgcctccgtcttcacattaccttcttttcttccgtgtgtctctctgaaccccctccctgtatctcataaggaaacatgagcttgcattgaggccccacctgaataatgcagaataagcttctcctgtcaagattttcaatcacaatttatgccatgaaagttaatattcactcctttgccatgttaagtaatattcataggtgtcagggattaggaagtatttgcttggtgcaaagttattgcggttttgccattgaaagtaatggttaaaactgcaattacttttgcaccaatctaaataaatgtatgaagtgaggttttttatagctgaccacagtaatcaaggttcattttcgctcttgcaataattgctgcctgtgacaactttttgtaagaattgaaatgttagaaacttttggaaatgcacaaagtaagcctgcctgtgtagttttactggaggcacatctgatttcctgctttttgccatgggaagaatccatgtgagcataagcagcatcttggaacattggaatatgtggacgagacaaaaagaaagcatatttctaagcctattcctgaaacaaaaacaaatgtgtgtgcgtgcacacacacacacacacacacacttttaatgatcatttttacttcaatctagaagttatgttagtaaaaatgctgcttgccaataagcttttgggaagataagaagagatgtatgatatgtgtgtgggggggtgtataaaaatgtcacaactctaaacccagaatattacacaatgagacactcccactaaagtcaagaacaaagaaggctagaatctctgcttttcattctcctcctcttctctgaatctctgcttaaaccattgttctaaacagaaaacatgataattggcaaacaagaaataaaactccctctatttccaggtaacagggtgagatacttgaaaaatgttaggaccaatgattaagccaattccaataataatagaattcagcaacatagtaggatataaaatttacatgtaaaaatcaggaacatttgtatagctacagaagaatttttaaaggtaaaggtaaacttgatttatagtagccaaaaaagtaaattaaggaccttaacaagaaacgttcaaaacttacatgaagttggctgtgaaacactcctcaaagatgtaaaagtagatttgaacaaatgaaaaggtattcttcattcttgttgaggattatcaaaatgttaattctctcaaaattaatgaatagattcagtataccctaataaaacgtcaatggacattttaatagtgctaaagaggaacatcctaaagttcatgtgtaaaaataaacacacataggccaggcgcggtggctcacgtctgtaatcccagcactttgggaggccgaggcaggtggatcacgaggtcaggagatcaagaccatcctggcttatgtggtgaaaccccgtctctactaaaaaatacaaaaaaattagccgggcgtggtggtgggcccctgtagtcccagctactcgggaggctgagacaggagaatggcgtgaacctggaggcagagcttgcagtgagccgagatcgcaccactgtactccagcctgggcgacagagcgagactccgtctcaaaaaaaaataataataaaacaaaacaaaacaaaacaaaacacacacacacacacaaatagttaagaaaatacaaagaagggagagctatgagagatctaatcttacaagatattaagacatacgtaaagcccctctgattaaaacagtgtgttactggcacacaaatgaacagatttatggaacagaatggaaaggaccgaacagataaatctagatatagaaattcattgtatgacagaagtagacctaaaaatcattgcagcaaagatgatcttttgaataaatgatgttggaacaactggacagccattttgaaaaaaagataaagttagattttatcttttagataaaattgattttatctaattttatctaatttatctgattttatctaatttgataaaattagattttatcaattcttgtgccacccaaagaaaaaatggtaaattgatccaatgtctaaatataataaaatgaaactggacacatgctagaagaaggcatgggtgaattcctctgggtgtaggtaaaggcttctaactgtgataaaatcccagatgagatgtaataaaaataaacactgataacattgacaacatataatttctctttttttaaagttgcatagtaaaatgccataagcaaagccaaaagacaaatggcaaactagaagaaaatatttgtaacatctgtcacttgtgtcttagccctctcttacattgctataaagaaataactaagactgaataatgtatatatattaaaaaatgtaaggccgggtgcagtggctcatgcctgtaataccagcactttgggaggcagaggcaggtggatcacgaggtcaggagtttgagaccagcctggccaaaatggtgaaactccatctttactaaaaatacaaaaattagctagtgtggtggtgcacggctgtaatcccagcaattcgggaggctgagacaggagaattgcttgaacccaggaggtggaggttgcagtgagccgagatcacatcactgcactccaacctggaagacaagagcaaaactccttctcaaaaaaaaaaaaagtatatgtatatatgtttaattggcttatgtttctgcacactatagaagaagtatagtggcatctattactgggcagtcctcaggaatcttcctatcatagtgggaggcaaagagggagcaggcacctcacatggccagagcaggagcaagagagggagagagagagagttaaaggggaggtgccacacacttacacacttttaagatagcaccaagccatgagagatccacccccaagacccaaatgcctcccatcaggccctaccttcattattggggattataattcaacatgagatttaagcagggacaaatatcctaactatatcactccactcctggactctcccaaatctcatgtccttctcatgttgcaaaatataatcatgccttcccaacagtcacccaaagtcttaactctttccagcattaactcaaaagtccaaagtctcatcttagacaagccaaaccccttctacttgtgagcctgaaaaatcaaaaacaagttaattccttccaagatacaatggagacacagacagtaggtaaatattcccattccaaaaggaagaaattgactgacataaaggatattataggccccatgcaagttcaaaatacagcagggcagtcattaaatattaaagctccaaaataatctttactctgtgtcccactatccaggccacactgatggaagggatgggccctcaaggccttcagcatctctacccttgtgactttgcagggtttaactcctgtggctgctctcacaggatttaagtgcctgcatatttttgaggcacagagtgcaagctaccagtggatccactattctggggtctggagatcagtgacccacttctcacagttccactaggcagtgccctggtggggactctgtgtgggagctccaaactctttttctgcttggcattgcatctagcagaggttcttgtgaggcctccactcttgcagcagacttcctcctgggcacccaggctttctcatacatcctctgaaatctaggcaggggctgccaagtgttcttcactcttgcattctgtgtatctactggcttagcacaccatggaagctgacagggcttatggcttgcaccctctgaagcagcagcccaagctgtatctggtgccttttgagccatggttggagcatgagcagttgggatgtgaagaacagtgtcccaaggctgcataggatagtggggccctggacttgtcccctgaaaccattctttccttctaggcctctgggcctgtgatgggagaggctaccacaaaggtctctgaaaggccttcaaggcctgttctccattgtcttggatattagtactttgctctttttccgttatgcatatttctctagcaagagattgctccacgtcctgcttgaattctggaattcctctccagaaaactttttttttcctcttgccacatggtcaggctgtaaattccccaaacttttatgctatgcttcctgtttaaatattatttcaaatttaaagttatttatttcttcccacatctgagcattggctgttagaagcacccatgcaaatacttagcagcttagaaatttcttctgccagataccctaaatcatcactttgaagttcaaacttccacagaggcctaggacatggacaaaatgcagccaagttcttcaataaggcataacatgtgtgacctttgctccagtgccctataagtttctcattttcatctgagaccttgtcagccttgacttcactgtcgatgtcactatcagcatgttggtcacaatcatttaatcagtgtctaagaagttccaaagtttccctcatattcctgttttcttctgagcgctccaaactctctcaacctctgcctgctacccaatccaaacctgctttcacattttcatgtatctttatagcaatgtcccactcttcagtaccaattttctctgttagaccattcttgcattactataaagaaatacctgaaactgggcaattagtaaagagatttaattggctcatggttctgcaggttttacaggaagcatggtgctggcatctgcttggtttctaaggaggcctcagaaatcttgccatcatagcagaaggtgaagggggagcaggcacatcacatggccagagtgggagcaagagagagttggaggggaggtgctacaccctcttaagttagcaccgagccaggagggatatgttctcatgatccaaacacctaccactgggccccacctccagcattggggattacaatcaacatgaagtttaggcaaggacaaatatctaaactatcaacagacaaaagtataatatcccttatttatagagatcttttaaaaattatggggtgcagagaggaccacaaatcttatggtaaaatggcaaacacatgaatagacaattcataaaaagatatatagtgcccataatcatattaaaagatgttgaatttcatgaatacctaagataaataaagcaataccaggataccactcatcacccatcagattagcaacaatttaaaagcttaacaatgctttcttctgttgaggatggggagaaacagacattctaatatactgctggttggaatacaaaatggtacaagacctatagagaggaattggcaatacgtaacaaaactacatatgtctttaatttccaactcaacaatcctcccatcctaattctaaagatacatcttcaattatttgaaaatacatatgaacaaagttattcattgctgcaatattctaactgtaagatatcaataaccatataagtaagcattggagattttgtgaataaatgatagtgtgtaaatacacatggagtagtatgcaagttaaaaagaatgagaacaatctctatgaatttgtatagagaaattttcaaagactattgttcattgatcaaagtacaaatgtatgaatatatggagtatatatgaagaatatatggagtatgcacatttcatgtaaaaagaagggaaaatagacatatacacaaacatgcacacacttgcctttacataaaaacacagtaaagataatcaaggatccaatgaaatgggttacctacaaggaacaggacggacaggatagaaaagtcttgccacttttctggatatgtcttttgtatagatttgactttaagaagcatgttaatgtcctgtatatccaaaaatgaaactaagtcaatatggatgagatggacaacgtgaaactgaaacaaacagttgcattaacatggccacaatgaagggaagaaaaaatacactaatccatgtaacttagaaacacagtatattgactatatagtctcagtcttgggcaaggtgtgggaaggattgcaaaccacaagaactctttctagatagatatgatttttgtaatgaggtgaataagtaattctgaaataattttagatttattatggaattaaaccaaagaataaacgtgttaatattcttgggagtcagtattctcattatggaagaaagacgtacaaatatcaaaggaggaaagcaataaaaatccctgtagcgatagactgggtttggaggtatcactgtatactcaatatttctaaaatatgtgtatatttgttatgcagttacatgtgcacatgtatatatatgtatatatgaacacacatacatgtacacatatatagatatgtttatatagttgcatatattgatgtgtgtgtgtatacatacatgtgtttcttaccttgatacaataaaaagacctaaaggtaaagacacaacatttgcaatgagcacatatagcaccacatcttggtcccgaataccattgctctttaataggacgagagtttctcaaagagatgcctgtttctgaggttgaaagaggtgtgtgcaaggtgagcctggagcatcttgctatgtgagaaagcaaggagtattcttacaaattgctaggcacatgtcacaaagatacaagaaccagcttgaagggattcctattgctcaagtctagaaaaatttgagtaccaaaataatgagctattgtaatggcatttaaaccttgagaaaaaaatcagataccattagtccgtgtcactaacaaatagacaaatcaataaatgggggaaaagggtgggctcttcttgcatcagaatacctagtgctatttgcaaatgtggagctggtaatggagttaggaaatcatcattttgcaaacatgataagaagattgggtctggcaatactcatcattggatggggtgctaacattggggagaagttttgaccgggagcaagatgtttgcttggtcttaaagtatctcctcacagatcgcttgttagttggaagagaagtagtacacagtacagaaatcagacatcatcttaactagatgatgaaaattaaaattagtactgagaggcagaagggctttgtgtgagtgaggagggagataccctgacaggagcacaatatcgcttgtatagtattctagccaagaatgagtaacccgtatctaaccatgaggaaacatcagacaaactcaaaaggaacattccgttcaaaaagggcagaatagagttatattcttcaacaacataaatgtcattaagacacagaaagacagtggaagtgttccagattaaagaagaccagagacacagcaaatgggtataatagtagcccctagattggctccggtatcaggcaagaaagaaatcccacaaagttcatcattgagttggttgatgaaattgaaatacaaataaagatttgacataagtatgtcaatgatatatttcctgaggtcaataactatacactgtgaagatgttctctatgttcagatatatcatccagagaaaacaatcaagtaaatgagataaaatgttacagagaaaggatgtaaagttgctccacatactacttgttttattcaacttttttctgtaaatttgaaattatttccaaataaaaaattaaaatatgtttagaaaacatgccattttcaccaaaagaattgtatagaatagcccatgaaacactctttaaagtgttcttgatgtcaaatttgatctgtaagttgacatcctcagattctttcaaatgcgcgacaggtttacacagttcacatcatctgcctcattgcctttgacaaatagatttctgcaatatttagactttcaggcagtgaaagtcagccactaaacaattgctctgggacattaccattaccaagttcttctctctctctcatctgctatgcagcaaatcctatttcatgcattctttcaaaaatattgtcacaggatctctagatttctatcagcataatcaagctttctatcccctcattttgctcttgtatataatcacaggatgtctccatcacttaatgccacccctatccattctagtcgtactctaattaattaagaaaataaattcaagcttgagaaagtgaaataaacaacaatttgttaataaaacagtatcaaggctgcagaaatagacctttagctaatatacatacttttccacacaccatgaccccttcttcacttcaataaaattcctactcccagaagattctttctcttttctccaatgccattgacagttctcctccagatgttccatatgttctttgccttatcagtgtgaagtcatatgtgtgagtgtgtctctgtgtgtgtctgtatggcctggagtggggaattcaaaatattaagtgactgcttccacatgatgaactcaagacgtatacgctgttttttccatatatataaaatacatgtgctaaaggaagaaatattgttgaggtccaataatttaatagagatagctatatcctaaccatcatgtgactgacttaggctaaaacttttttgctcgattgtttcctgtgttgaaagaattattcaatggactagcaatctgtgaccacgtttttcatgactggtacatttggatatggtgatatgcttatctcaggatttctttaatataggctcttgctttttgtttataagttcttttctaaaatatttatttagcagatattatctagttctttgagagtgtaatgcttttgtttaattacatcagaaaatttttagaaccagaatgatcggaaaaagattttctgagcaataattagtttttagagattaaaatggatttccctcaataattcatttcatataaaaactaggaaaattattgaaagcactttttttggccaaattcttcccatttagcatgtttgcaattttttcagttctatgccttaaatttctttttttcttcccccccattcatttgtacttttgtctaccaaacaaatcctctacaagaaaatcattccctactttagaggtttttgtcttatgccaacaaattctcttagccttttttgtttatgtgttagcacatagaaaagtagagaaaacctatttgccaagagggaggaagatgttaaacccctcacttccccaaaatggtaccgaaacataacatttcaggccaaatttatagcctaaacagtagttacacaatgaaaatgtattacttatcatagcaaaaatgtgttcattcttcacacattatataatattcattccttatgtacatatttaataacatattcctatgttattaaaaacaacaacaaatgcagttttttgagctatgaaatttaagcaaattagaaacgattaaaattacattgatgaatcttgaagttgatctaaaaaattactgttgaaaataaatagggtactggtatgctgaaatttacttaaataatttgacaagttaagtttgagccacaaaggatatatatgtgaccagttttaattgggaaaaaaatcatgggatagatacttaaatagatctggaggattcaaatcaaatttattttctaagaaaatgatagctaagaattaagaggcttttgatagacacttatcttattcattagctcttttgtgatactcattaacatacattaatttaatgattaaattacttccttttttttcctttcacattttttacatttagataggttctcactttgtttctcaggctggagtgcagtggtgtgatcgtagcgcattgcagcattgacctcctcaacacaaacaatactgcagcttcagcctcccacgtagctaggactacagccttctgccagcaagactgtctagtttttaaatttttgtagagatggggtgtctctatgttgaccaggctggtttcgaactatggttcaagtgatcctctcacctcagcctctcgaagcggtgggattgcaggcgtgagccactgcccccacccaattcagttttttatccagcattgtcagatatcgttctagtggaagatacagtagttgatataaatgatcaaaacttctgtctttatgaaacttatattctagtagagatgtcaaaaattaaagggaggctgggtgtagtggctcacacatgtaatcctagcactgtaggaggccaaggctggcagatcctgtattagtccgttctcaggctgctataaaagacatacctgagaccgggtaatttataaaagaaagaggtttaattgactcacagttcagccaactggagaggcctcaggaaacttacaaccatggtggaaggggaagcaaacacgtttttcacatagcggcaagagagagaagtgcagtgagaagcagcaggaaagcatcttagaaaaccatcagatctcacgagaactcactcactatcacaagaacaacatggaggtaaccgcccccatgattcacctacctcccggtgggtctctcccatgacacatggggattatgggaactacaattcaagatgagatttgggtggggacacagccaaaccatatcagatccctttgagcccaggagttcagatcccttcagaccaatctgggcagcatggcaaaaccccgtctctacaaaaaaaacgaagaaatttgcaaggcatggtggtgcacacctctagtctctactacttgggaggctgaggcgagaggatcacttgagtccaggaggttgaggctgcggtgagccatgctcgtgtcactgcactccagtcagggtgacagagggagaccatgtcttgaaaaataaataaataaataaataagtggaaattatacgaagaaaaatcattaaaaatcttaattatgaaggaaattagaagttcaaaggaagattagtgggtttattgaaagtgtaaatttgtttcatactcactgaattcacccagcagtctcaaggaaatatttaacatcaacaagtacttatatattggtgctgtattaacttttaattagaaagtcatggtctctatccaaagaaatgtatataattaatacattcccagtgttaaatataacctgttttttaggttaagcaactattgcatagcattcagttggtgttattgccacatctgcatttaactggctgtttctacaactcttactacgttgaatataaaagctcactgatcatgcagatatatatataatatatatacatatatacatataaaataaataaatcctaatggagtatttaactctagctacacctaggactatgaatattcctacagatttaaaagatattatttggagcatatgtatggaatgaatgttttcaaaacatgggaatgcaaatgatcttcattcataaatgaactaattgttcttaatgttattgaatatcatttcctagttacagagctggggaaaagaattaaatctatctatctatccatatatccatctgttattatgtatcagttctggctgtgcacatttttatattttctagataaatgttttattttagccacatggtgtttttttcttttaaaaaaaaaaagcaaaactgggtaatcaattgtgagaaaatgaaaaggaccttcccatgccactataaaagtatgccatatcttggctcagatccaattctgctgaatattcattagtgagtatacctaaatggcttcattgtcaatgtttatctgtaaaaccatatcttttcattattcgcattatcattaacaaatacacatgatgtgtatgatgagtacaaaatagaatacaactataattgactatctgtaacgtaaaaatatggaatttgtatcattttatgtaaaactactgcatcattaagtataaagcttccttcccttttaatgtaagttttaaaaaccagtgttacatacacaaatctttgcatttggtattttgtcctaattagagaaatcatatgataattaccctacttaacaaatgaataggccaggagtagtggctcagcctgaaatcctagcactttgggaagccaaggtggtggattgcctgagctcaggagtttgaaccagcctggccaacatggtgaaaccctgcctcttctaaaaagacaaaattatctgggcatggtgacacatgcctgtaatccgagctacttgggaggctgaggcaggagaatcacttgaacacggcaggcagaagttgcagcgagccgagatcgcaccactgtactccagactgggcaacagagcagtctctgtctcaaaataaataaataaataactaaataaaaataaggagcaaattcctttagaagtataatttattgcttattccagcttactttggtgtgaaccagggaagaggagaagttagaaaagaagaagaaactgacaaacatgaaaaccttaaatctcttgtcaacaaatattggaagtggcagcaaaaaaattgtatataaacattagatatatgaagcaaacatgtttttaaatccaaccttcattatgaatataaatattctataactttcattccaaaagaatcatgagcatgtgagaatcaatttctgcacagcagcaatgaaaagttattgaaataaatcactttgtcttttctctcaggattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttgggtatgttagttctctacattcagtatttaatgtggattgatttcaatagcacacaggtgtttgcattcatctcccaagaattaaagtatttttttttcacacagtaacgtttccttctgtgatgctatcttaaatcttgataacattatttttgaaattaagattattccttgtgaaaattcagtttcaaatactcagattctatgtagcacaactagttttgtttctagaggtagcaacactgttgattgatgtatggttttttttttccaaagggctctgtgattctcttgagaatcacagaaaaattcatctccaatttataagcaatacatgtgcctgtctcctgttaaacatatgtctctgtattttactgtaaatttgaggacagctatatcatatgatttctgttttctattaatttaagaattctattaatttcagcattaaattttaatttatataatatttaatggcaaatcaaacttatagtcttactctacagttttgtaatacagacaatgcgtatctatctattaatgcatgagtggtgaaaatgaaaaataataaggttgaaagtacttttgcacttttatacagaataatttttctagaatgaaatgttgaagcttccattcttgacagacatattttccttttttctaatgttatgtaacaacatgtgtctaattatagcatataattcatgttaagtaagctgtctctaataaggactgatgtaaattacttcaatctcacagaaatgttcaaaaatgcctgtttaccagcaaaccttttttattttaacctgtttctaacacattttattatgcttcttggtgtcaacagcaacaataatctgataagatagtttgcctgagttgtgggtatttgtagtggtctctggaattatttcttataagaatcatctgtttttagtttgggacaaaacttattgtaacacccaaagagataaaatatatgagtaggagtaaaactggaatcccaataatgtgactaaggggctttaaattgtgccttattattgaaattatttaaatcagtaatagcgaattatagatccagggaaacttagttacagagagatattggattgatgaaaaaataaaatatgactaatttgtggtccaattttcagtgatgcccaagcaatttctccagtaaaaaggcaaattccgattttaagattcatttcccttctgtcaatagagtatagtgaattgagttatatagtaattggctttttattacaattggaacagtaacattgtaatgccactggtgtgccttggcaagttacttaccttttatggatcacagtttcctcatttacaaaatgaggatcatttctaaagcttattccagctcaacgagtctgtgattctaaaaccctaacgaaaaaataaagagataagggggtctgaaagcacgtctttaccgtaaggtaataaccttctgccaggacgagtgcagtcaattgtgttatttcattcagaatttgaaaataacttcataataaaaagacaaagcaatcaaggaagaattgcatatctatatatagagagagatgcacttggttatctgcctgccattcaagcatcttaaaggtatttcaaataggaattttcgaagcaaaacatgagccacgttttctttctttctttttttttttttctataatggtaacaattgtgtcaccagtcccacccaacagaccagaagggtggcagcagctgctgcgtgggctcctccagaggcaatgcagcagggtgtcagcccagcaagatgccccgcccactcctgtaacacctccctgacaccccggaatgagcagagcagagacaggagtaggagctgcattcttctgcgttctgcagagacagcagagcagcgggtgaggctctgagccataccctggctgtcccaacactgccttcacgaagggggctagctccacgactgagaagtaaacagtggcggctgcagccagcgctgcagaaccctgcctcccttcccctctgccaaccattcctccacacccccacctcagcttgcatatcacgcaggacttgtagctccatgaaatcgaggggaaaagaaagatttatcgtccaccctctcctgctacttatttccactctactgatgctgctttttttttttttttttttttttttttttcgtttgtaggcagattgtatcttacggtctactttattatgttcaaagtgaacctgttaacctcttttgcctgtgttccgtagctgtgaatgagtctgtgcttttgaaggtactatatcggtgcagctctagttggaacactgaataatactaaagggtggattttttttttttgcaacaagtatataaaaatcttccttagttaatactaacagaaatttgttattctatccctgtttctctctgctgcataaaaagtaaatggttactaattgaaattatatcagcacaaatgcaattaattttgaagcagcaggccgggcgtggtggctcacacctgtaatcctagcactttgggaggccgaggcaggcggatcacgaggttaggagttcgtagaccagcatggtcaacatagtgaaaccctgtctctactaaaaataaaaaaattagccgggcatggtggcaggcgcctgtaattccagctacttgggaggctgaggcaggagaatcgcttgaacccaggaggcagaggttgcagtgagcccagatcgtgccactgcactccagcctgggcgacagagcaagactttgtctcaaaaaaaaaaaaaaaaaaaatgaagcaacattgtatcactgaatggagagtgataatcaatattccctttacttaatgaatgcctttgaaagcataacttggtctgcattctgtgtttcctttcatgcggtatcagcaccaattcaagttcattacaatattttaatgctatctgtcattcaaaatccagaatttgaggcacgtaaaaccacaatattaaattttgagggtgaaaatcattattaacgactttattaaaacattatatgaaaagttattaaagtattttaagtaacaaaatttatttaccttaaatattaaatggcaccaaattgagtacaaatacatgttattgactacattgaacatgacctttttaagtttaatgtagaagtatttattttctttaaccatattttcttattaaagtttaagccaaaacatatttattccgctgcaaattaggagaccttcagtgtgtcacattttcaaatcttgagatattttttgcccccatccccaattttcttatttctacaaatttccgattgctactgtgacatcattatggatctcagaatttatctatacttcttctgaaatttagatttttaaatgcaacactttcgaagtaatagatttcccaaatgtactaaactctatggaattttcaataaatgtattttccataaatctacctgctctaagagttaaataaaacaataataacttttggaagtgtgtttactagtttgctagggctaccacaacaaagtgctataaagtggatggcctaaacaacagaaattcattgtctcacagttcaggaagctagaagtttgagaccaaagtgtcaccgggttgattttttttttttcctgagggctgtaaagaacacccggttccatgtttctcccctaccttctggttggctgctggtaatttttggcatccagtggtttatagaagtttcacccatcactgccttcacattcatatgatgttcttcctgcctgaaaagctgtgtccaaatttcccctttttttataaggacagcagtcatatgggaatagagcccaccctagtgacctaattttttactttttcaactcagtaaagagcaataaggtcaatctctgagacactggtggtagaatttcatcatatgaattttgtgaggacacaattcaactcataacagtcttatgataacagtaatgttcttccatatataagttttaaagaaacaaaattaactagttgctattgttaccctgtttcagagataaagaaacataaaaggttgaatatcctaatctgaaaatcccaaatctgaaatgctccaaaatgtgaaactttttgagcgtcaacgtgatgctcaaaggaaatgttcattggagcattgcagatttggggtatttggatttgggatgttcaactggtaagttaatgcaaatattacaaaacctaaaaaaaatttgaaattcaaaacacttctggccctaagcatttcagacaaaggattttcaacccttattctatttgtttagtttaaaacatctgtcttattagcctcaggtgtttgtagatttggccacagcatattagattagtatttttaagacatactctgtataattatcttaaaatctattctgtataactcacagctccgttccatagcttaaaatcaaattttagtactaagtttagtaataataatgggaaatatttgttaggcacttatatatgcccatactatacctactatgcttaattgtaggacactgaatcctctgataaactatgtcatgtagatactagaattatcctcatttcagagatgaagaagctgcctcctggagaggatgactgacttgcctggggtacatggtgggtgatgaagccagatttgaattcaagcatctggcacagagtccatgccgctaacctcatgattagggcttccctaccattttatggtttatttgagttcatttaataggatggttatctgtttacgagggtcttttataactcagcagtcattttctgttttgcatcttagtaagatcattcactggtcattggaaagctccttcattacagagatgtcctcattttaatctttgcttttatcaacaataacgaattgtctcttttcacaaatacaagaatgctctgcaggatgtgagagaacttggtagtctaagatgcttttctgtgactaacagactttttgatgactagctctaaggaggcctaagatgaatttctaagtattgtaaagaaactctgcattctagactatccctaaactttaatgccttttaaaataaacacacacacacacacacacacataaacgtttgaatcctaaactgtgggaatagaattcctagaacaaagctttgcctctttctagaaacttaagacaacatcatttttttttccagattttaactggtttctcagcaaggaagatttggggggtggggtgtaggaggtgtagactccttcaaacataggggtgatattttaaaaaaatgtttgaaaaaccgtggcattgaggaagaagggccaggattttatttgctgcaagtatctgaagtagatctcgtatatcgcttcagaactgaactctaaatactaggacagtggaccaatctcagtgtaactgttgagatattaactatgctagtacataaattgtaggaagaaataaataagaaaaaataaagttcttattttttctgatgtctaatgtaaaagttgaaagaaattttctgctagtctcataaggtggcattgataaaatagaaaactgtgtaaagcatctagtttagattttaaaatacaagagacttacaacagccagaaatggaaaattgataaaaagtttgcaacatgtggatgcttctcagatcaccataagttgtgactgaaattcaattaaaataaaaataacttctcaaaatgttcaacattttattttgtttatatctgtttgtttttgattttttagattattcaagtcatgatatatactctttggccaaaacttaaaaaaaatttgtatattctcctatcagattgttctaggatataatgttatataatttgtgactgcctacatttttataatcctaaagtaatttttaaataaacattttattttggaataattttagatttacagaaaggtaaagacggtacagttccatatataccaaacctagtctgccctgtgactgacactctactttaatatggtatatttgctacaattaatgaaccaatagtgatacactattgttaactaaaagtccatgcttctttctgatttccttagtttttgtaaaatgttcttttcctgtttcagtatcccattcgggataccatattacatttaattgtccctccttagactactaagaactacaacattttctaagactttcattgttttcaaaggccttggcagttttaaggagtattggctgagtaatacattttgtaaatgcactttggctgtaatttgatgtttttctcatgattagattggggttttgagttatgaggaggaaggttacagagataaagtgtctttctcatcacatcatatcaaggctgtctaaaatacttttactgaaaaagaaaaactaaacacatgaaatgacacattatctgacccatgctttcctaaacaaagtagttctactaaaaataattacataaagaatttattttatgataaacatcctgtatatagaaggttaatactctatggctctctattttgtttttacagaatacttaaaaccttgaagtttctaactttgttaatataaaattaaattgtagaatgtgatgccctctaaaaagtttagggaaatatctccataacgtatgaatttctaatttctacttacaaatatactatagtttaaatgaaggcatctgcaggtttaggtttttcaatcaaattttgcaataaagccaggaattaatctcaaggatagcaaatgctcagcctcaactttttagacttgatggctcccaaggtaacaatctggatacattcattcacattaactgttgtcatcaatgtgattagctcaatattacacattcaggtgacactcgacaaggaaaatatggttgtaaaattggctaattccagctcaactacccttccagtatgccagatagtttcaaacatgtaatagttattattaaaatagaccactagagtaaggatgaaataataaccacagactattaatggtcttttaaagaactgataggttgatgagtgcctctatttttcaaccagaaatcgtatgcctactgtactgggaaaaatctttatgcaaagatattgaaaaattattttcagaaaaaactcaagagctacattttttttgactctgcctttcaatcaataacattttacaaaagatatcgcttcacaacatattgagactccatttctttatctctgtttctcattttgagattaaccactactatagtttatattttaaggttgctttatggggaaactaagtattttgagggtattaaagttaaatgttcactgaagaattagtaagactagcattattgtattgggaacacgggtcaaaagtacatttctcagtccgggcacagtggctcacgcatgtaatcccagcattctgggagaccgaggcaggtggatcacctaagggctggagatcgagaccagcctggccaacatggtgaaaccccttctctactaaaaaatacgaaaattagccaggcgtggtggtgggcacctgtaatcccagctactcgggaagctaaggcaggagaattgcttgaacctgggaggtggaggttgcagtgagccgagatcatgccattgcactccagcctgggtgactgagtgagactctgtctcaaaaaaaaaaaaaaagtacatttttcagacatttacagtatcactgatattaaaattatattatattgttagtactcaccaaatggaaatttcctttgcagtaatatttgctggaaaaaatgtatattctactaagatgatgcctttttttttttaaatggagttttgctcttgttgcccaggctggagtgcagtggcatgatctctgctcactgtcacctccacctcctgggttcaaacgattctccggcttcagcctcctgagtagctgggatcatgggcgcaccaccacaccaggctaacctttgtgtttttggtagacataggttttcatcatgttggtcaggctggtctcaaacacctcctgccctcaggtgatccgcccgcctcagtctcccaaagtgctgggattacaggcttgagccaccaccacggccgtccaatgcttttattttttatataatttgactttatttgaattttgttttcaattgaaaaaataaaatctctggctcgattttatttttttttaaggatctgttacacggattgatgtgtcatcctgagttatgaggattcatcaagaaacaaaacagaatccctatccctcgggagtccctagtatagtcagaatacatgggagacttgtacatgaagacatgcatgctatacatattgatgaacatgcaaatagcttacagtgtttgcacggagagaagggattaaagtctgtgataaagaagtgttgactagtagacacctaaggcctagtacagtacacattgtgggcacacaggacattttaattacagtgatgcaccccctaatgtgttcatcagtgctgaaccacgtgtcagagggtggtcctgtaggctttcaataccatatttttactgtactttttctatggttagatatgtttagagacacaaatacttaccatcctgttacagttgcctccagcatttggtatagtaacatgctgtgtagatttacggcctgagaacaataggctataccatgtagcataggtttgtagtaggctacacatctaggtttgtgtaagtatatattaggatgtttgtacaaagactaaattgcctaatgatgaatttctcaaaatgaattcctttctttaaaggatgtataactctattaacaaattagtgagtaaaaggggctcttgatcttgggttgggaggatagaacgaacttctacaagtaacccagaagatgtgaagtagaatgaaatacatagaggactgcagtcatccgtgtgctagatcaggatggagaggttaagtagatgcaaaactctgatgcgtcatgtaaatcttgaagtatatgaacatgatttgttgagtggatgagaccaatgcaagataataaagaagaaagtattgcagttagtttttaaaagttaactttattttttagagcaattttaaattggcagcaatattgaacagaaggtacataggctcacatatactcctttttcttacatatgtgcagcctcccctcctattaaaatccctcaccagagtggtacatttgttacaatcaacaaacctacattgacacatcatcacccaaagtccacagtttaaatcagggtttattcttggtgttgtacattctatgggtttggacaaacgtataatgttgtgtatcaaccattacagtatcacacagagtgtttcactgccctgaaaatcctctgtgctccacccattcatccctccctcacccccaacccctatagacagctgattcttttactgtctccacagtttgtctttcccagaaagtcatagttggaatcatgtagtatatagctttttcagattggcttctttcacttagcaatatgcatttaaggttcctccgcatcatttcatggctttatggcacaatttgttctttttaaaaatatttatattttggctgggcacggtggctcatgcctgtactcccagcaccttgggaagctgaggtgggcggatcacaagctcaggagatagagaccatcttggctaacacagtgaaatcccgtttctactaagaatacaaaaattagccgggcgtagtggcgggcgcctgtagtcccagctacttgggaggctgaggcaggagaatggcgtgaacccaggacgtggagcttgcagtgagccgagactgcgccactgcactccagcctgggcgacaaagcgagactccatctcaaaaaaaaaaaaaaaaatttacattttaccaattgattgattgattgatttaaattgacaagtaaaagttgtatatatttattttgtaccacatattggtttcaaatatgtatacattgtggaaaggctaaatcaagctaattgataaacgcattacctcacatggttttttgtattgagaacacttaaaacctactctcttaaccattttcaagaatacaacacactgttattaactatagcgaccatgttgtacaatagacctcttaacttattccttctaactgaaaccttgtgtgctttgaccagtatctctccccaaaccccatcacctccagctcacttctttttagcatggactaacattccattgtccagatgtaccaaggtttatttatccattcacctactgagaaacatcttggttacttccaagtttcggcagttagcaaaatgctttaaacgtctgtgtgcaggtttttctgtggacatcagttttcaactcattcaagtaaatatcagagagttgatggcaggattatatggcaacagtatggttagttttgtaatgcattgccaaagctgctgtaccattttgcattcccataaaaaatatgtgagagatcctacattgtaattagttttgcgctttagaaaaattcttctgattaaaagtaaaggctggattgaagaggaaaaatgtttgaggtagggaaaatttatattttttactctgtcacttatgttcttattacttaatgattttatatatagttatttcactaccatgtttgcttccaattgtataagcagtgatttttttttaaactttctatattttaatttggccatgtcatttctaagttaatatgatttgttttctagctgctattttgggtgccctatttagaaatcatcctgatagaatcttcttgggtttttcatatctatctatccatatatctatatctatagatatatatctgtatattgctcttcctacctgttagataggtaaatgtctaaatatttacctaatatttacctaataacctaaatatttaaatacctgctaaatgtgtttttttctttggttttgtttttgggtttttttgagacagtctccttctgttgcccaggctggagtgcagtggtgcgatctcggctcactgcaatctccgcctcccaggttcaagtgattctcctgcctcagcctccctagtagctgggattacagacacaaaccaccatgcctggctaatttttgtattttaagtagagatggggtttcaccatgttggccaggctggtcttgaactcctgacctcaggtgatccacccacctcagcctctgaaagtgccgggattacaggtgtgagccaccgagcctggcctagctaaatatggttttaagtgagaaagaaagcgaagcactagttgaaagtgtgtgcgaggtggtatgcaggcaagagggtgtgctcctgtaatcactcccttccgtcaaaacccccagtatattatacagggaggtagaatcacactgtggcatatatttagatattttctttggtatgcctcattccattgacaatcataataatattaaatatgcctgtcattgttttgtttaattgctttctgtggttctttaaaatttttcctatcacaaacctggatgtaattttttttaaaaaaatttatcatttcagtctatatagttctgttttatttctattgaatgtgccaaaaagtattcaagtagcatttttttaacatttttaaatatttgaagttctgactcaatgataatctctcagcagattgacacacgtatatgatatatgtggtgttctcctggattttgataaagcttataatttcctttacatgatcaattttaagagctatttttgtgttataatttcacatataaattatgtcctgtatgttgtcatttggtagaaaaacagacatattctcaatggtctgaaacatgtctcacttcatcccaggacaatgatatgaagagatgtaccaacatttatttccaagactttttctggtcttgcgcaactttctgaaggtcacaatggaggggctgatttaaagagcaaaaactcacatgctggtttagggatcatatgctttcaaacaatggaaacacctttaaaacaataattacattttagcatggccttcttcattgctccttttcaagtttaaaaatgaaaactaacatcctcagtgactttcagtgacttttttttttttttttttgagacagagtctcactctgtcatccaggctggagtgcaatggtgtgatctcagctcactgaaacctccacctcctgggttcaagtgattctcctggctcagcctcccaagtagctggaattacaggagccctgccaccacacctggctaatttttatgtttttagtagagacggggtttcgccatttcatctgaaattaaatgcccgtcaaggaatgcatactggttatcactcacttctaatgaaattatatttttctttgatattgagatatattcaatgtgtcaacattgtttaaattctccatctgacttagaaagataacattctagtgtttttatcagagttatatatacatttattatgtatacaccaagtatatactgattgcacaattaaatgtattcagggtttgcatgtaaatctgatatcttaatttttttggttacttagccaaatattttaaaatgaaagttagaataaccaaggtagaaaagtccataataattgttcatcagtggcagaattaccttacttgcaggggtggtagtaaaaagtgtcacactgtcaacctaagtgagaaaatatagccatagctagaatttttcttccacataaatcagaccagcatatgcattcaatgacagtttacttgattttttttgcttcttcattctaatttttgttaattttaatttgaggaagaagaagcaagacccttgttaacaggggaatttgagtagttttagctcacccgtggttaccctgttttattaagtaatagcaacactttctttttgtgttttttaaaaaattgtgattatattagtgtacactttttccagcaatatttttgttattttttagcaacatatttcctttattcagcattatatttctaagaaaatatttacaagccaagagtatgtctagtgtttctattttttcacataatatattaaaattttcaacacatgaattcatatatttatcattagtgccatacttggttgtagacaacttttatgtccatatacttctttttttttttgagatggagtcttgctctctcacccaggctggagtacaatggcacaatctcggctcactgaaacctctgcctcccagattcaagtgattctcctgcctcagcctcctgagtagctgggattacatgcccggctaatttttgtatttttagtagagacggggtttcaacatgttggtcaggctggtcttgaactcctgacctcgtgatccacctgcctcggcctcccaaattgctgggattacaggtgtgaaccatcgcacccagcctatatacttttttttaattttgctctcccccaaaatcttttacttgtcctcatcttttccaacaaatgaggaatcatcatcttgtaaaatcttgagatttgtcagtttaaaaatgacatttaacgtcaatactgtattattgtgaacagttgccttttatttgtcatatttttatttttagttatcagttaatgtatcaaaacccaataaatcataatgataaacacatggtaagatatatttcctcacaagacaaaccttacattcacactattgttcattcaacagatgtttgttgagtgtctactgtgtcccaggcactattttgagccttagagataagcagtaagtaaaacagacagaaagttgaatatatttccccatctaagcacaagagctcatgctctgatttctattaattttaactggtaataaaataactctggataatatgacatgataaacttatcaagagtgtgcttgcctttctattgcaattttcatgactatcattttggggctttagacattatgtaaacctgttccatttaaaaaataaatttatggaacataataatccagttttggttatgttatttttctcttaactatttttaaaaaaggacattgaatactttcaatactcttttaccttctgcaaagtaacaatacatagtaatactgtatttgttatttcaatgggctatttttattttactctttaaaaaaaggtatctccgccaagtgcagtggcttactcctgtaatcccagaacttttggaggccaaggtgggcggattgcctgagctcaggagtttgtgaccagcctgggcaacatggtgaaaccgcgtctctactacacaaaaaattagccatgtgctgcggcgtgcacctgtagtcccagctactctagaggctgaggcaagagagtcgcttgaacccgggaggaggaggttgcagtgagccgagatcatgccaactgcactccagcctgggccacagagtgagactttgtctcaaaaaaaaaaaaaggaaaacaaaaacaaaaacaatttatctcatatgacaggatttaagattttcttcctctatatctaaggtaacatattttcagcccttacactcactgcctgaagattctctgtagctttatctctgtagctcagtgtaggaaaccagactgtttcacagatcattttattctgatgaaatcatccttgccaattgagattgaagtatttaatcatttcacagtgacactggtgatttttatgaaccaaaccacacagtgaacacttagatcgtattaacatttcacatatgctcatgaataaattcctcaaatcattttttgttatataaatagattttatattttagaaccgttttaggtttcacagcaaaattgaggagaaagtacagggatttcttacatagccccctccccagcaagtggatagactcccgttatcactacctcaccaccaccagaatggcacatttacaattgatgtatctacattgacacatcacaattgcccaaagtctacaatttagatgaggattttctctgggtgttgcacattctttgggttttgccaaatgtataatgacacgtatccaccattatactttcatacagaatagtttcacggttctacaaatcctctgtgctccacctattcagccctctcaccccccctacacttggcaaccactgatctttttactgtctccatactttttctttttccagaatgtcatagagctgaaactacacagtaagtgaatgaccttttcagattgttttttttttttcagtcatatgcatttaaaatttctgcatgtcttttcatagcttgatagctcatttctttttagtgctgattaatataccatcgtttatctagatgtgctggggtttatatatctgtttatctactgaaggacattttggcttcttccaagtttgggcaattttgaataaagttgttataagcgtaacaaatcacttaaaaagaattttccgatcacaacttgagcataggtagttttgggctataatgctgacaacgatgatgatgatgatgactgcatatttttgagtaatttacataatgatttagtaattttctctgcattaagctatacactgtgtaatttccagagcctacttgattgtaatgttttttccctttgcagttgtagtgatagtatgttcaggtgttcattttcttccctttgacttggtgttctcctgccttagtgttgtggtttatagccaagagctattttcccctcaggaaaattgagacattttgattgcacaaccgacatctgacatctagtggttagaggccagggatattgttaaatgtcctatattatacaggacagtccccttaacaaagaatgatctggcctcaagttcagtagtgacaaattcgagacactcggatttagatatctggctcatgtccggtaccccactcattcatgcctttggctattttattgacattagtaggtgtgtctggcttatcatctcattgtttttttaaacattaggaatagtaccctgtcagagtctaaagttgaagatcaaataagtcttcacaacacatgtactcctgagatctcctttgattccaatatagaaagagttcttaacactggatatctatgagaatcacctgcagtgattttaaaagtatagatacaattagcatgagagaggcctgagctgctttttctctctcacattaaccagatgatcctaatgtctggccatggtgaaaaccattattagaagttgcattccctcagctactgtctatctattgaagctttgtttaaaatcacaggattattaaactctgaactatttctgcctttgataaaatttaaagatacttcctttgttgttaaagtgggaaacatgattagattgctactctttaaattcattccaagatgagaaaatactaccagaatatatcactgtgaaatataaggttctgagctaagacttagcaaactatttttatatcctgtgccttgaaacagtgagaaacaatgacctgagttcaatctgatagaatatttttggttataaagagactttggatacatcagaacatccattttattcatttcactaaagtttaaatgtgcctcatatctgaaactcttcattatatcataacattccattcaatatgtggcatatgttttcatcacttagttcagagactcagagacttgtgcaatcagagtcagctggcttcttttcatcaatgctgctgacttccaaggtgttatttttacctctactggtgcacatctgctgaagttgccacagaaagtctagacctcaacagggtgtgattttcttagacattaagtctaagttcataggagttcagatgaaaaaccaattacattttacaagttattttcaagttaaatacactgcaatctcaatggctacataatcaagaagcaatatgtcacctttttctaaagaacatgaaaccttgcctcttgtagttctgtttcaatttctctaccagatttctaaaagtgattagaatatccagattgacatcaaaacaataattacatgtggttttatttaatttcaagtgataaagaaataattcgtaacaattttgttgaatcaaatgctaacatgtggtaggatctcaagaaatttatactgagtaaaaacaaaaatcaagcaggaaatatagtaggaggatgcttgttttgccagacatttgcatgttctgatgaaatgctactaaaatgattatgggataatggaatatgtcagctattaattaaatatatagcacccaatctttatcattttataccaattttactatcaaagatcaatgaattaactaattcaaattaaggaagttttactgaatttttttttgtgggtcaagaggatttagtcagcattttactatatgtgagtgatcctaaataatgaccaaaatgagaaaggccaatgaggccactttatttatgtaatttctacagaacttatcttcccttcctagaattactataaattaaaattcagtgtctgttcaaagcaataaataccaaatgggacagaaatagtttccttatgtccatacctaccctttgaaagtacaaagtaatacatttttattaaatcagactatctcctctctttgagttactgcttacatttcctgctaagtgactttatatagaaccttccccttgtttacatcatagccctatgagaaaattatcataatttccagctcgcaaattacaaaagtgactatgagggattaagtgatatgtcaaactagtgactaggtcatctgatttcaagttcagtagtacttttatcattttttttcatttttccaccatgtttcccaaacagatattatgaagatgaatttcagaaagagttgaatcaaaaaacagaaattaataaaggcacacatatacaaaaatggtttttaaaatcagaaaaatttttcacattctcagagtttattctaacaaaagtaagagcagcttattaatttatttaacattcagatgacaaaatatatatatccatgatatgcttcaaaatgtgaagttagaaataaatttataattatgcaatattttatttattacataaaaagattttctacgtaggattacgcataatcaatttgaataattcttcaattttagtaatcatcagattctgaaatagaacataaaatggaaagatcaaattatattttagcttccttaaatactttagtgaatattttagtgaactgctacaccctgaaatgccactagtttacattcaaaattagaaaataaagacttttgcatttttctagaacaaaacttatgcattaatagtaatgaaaatattttctcaccgcactgatttactctatatcatccagctttgttaatttgctgtaacatagctcagagtagaaagaagatgtaaggcagtcctgtggtttcagaagttagacctttcattgccttgtaaagtagcagtaacaacacacttcaaagtgttccaagctactttgaatctaaacctattgaattataagtcccattctacagtgaacaacatcttcaaaagaagctttagaaagatccctaagggtagaacaaatgaaaaataagatagaaaggatgcaaccaaaaggatgctgattactcttccatggattttagagttgcttttagtcctccaaagcaatgtgcttcaggctgccatatcatgtttattgttctagagactatacattagccttgagatctacaattgcaaataatgaaaatgttaataaaaaagattttttcccccaaaggtgttcttttaagaagatttcttcactttcagggtggtttccaagaatttctggaggctttcttctagagagagagctcattttgaataactttccctgactcaagaactcatcattcttttaatttatccaaacatgaaatgaaatctaattcctttattctataagactatatagaattacataattacatagtatgtacaaaatatatgtagcaagagtagtaatcacattgatattttcaatgataaaaatagctaatatttttgtcagagcttcttatgtaacaagtttcaatgctaaatgcttttcatgcattatctcatctcaggctcacttaagcatgtgaagccagtttagagttatttccattttacagaaacagaaacggaagtataaagagcagactacactcaagccagctgaaaagcctgtgcctttcatcagtatgcctgaagacccccttttattgctaaatgcacgtgatatttagtttaggatcacagtaagtggtatgccagtgattgttaaataaacggagagataggtttctacctcttgcatattagaatccaatggcaaaagatggaaaatgacctgcattatgtcatagggcttattagtgttagaggtgaatgggtattgccgcttggagtatacttatccacgttcagaggcttagctgaccattgtcacttagcctgggtgcctaagcaatgatgtgatagggtagggaaggctttgagaggggagaaattctgagctgacccctccactgttctgtgagcttcacctattgatgtgcttcattccacgttccagaaagaaaggataaagaccacttaaaaatattaatattatcctttcactctggggaagatgagtaaaatgtttaccatatacagtcaagtgtgtctaaagaccaaatattctctaaatttccacctgggctattttattcttttaatcagtaaaataagggggaagtgttattgccttacgtgactgaaatcctgccataaatctttatgcatattttgcctcataagtgtttgttcagcaagactaaaataattctaaaaggaatgtaaactttgatattattttaaaaaagaataccttttttatgatagttactctccttccttcggtgatttaaataaattaatattcagcaaattttatttgctaatattcttaaggcagggtttgtttcatcttagatgtataaagtataaatatgtctgccaaatcttagtttaaggacgttgttgagacagatgttgaccccaactattagcatttcatagtagagacaaaaaggaagtaagagttgagatgagataaaacaatattattagaaaacatgtgtttgagaatgctctggggttctgaagtactggggcatttagtaactgctatttaataaaaaggtttgatctcctgcctctctttatatttgtcatataaattccttgctatccttaatcccaataaactctatgttaatcgcaatataactttaatatacgtgcataagttctatcatgggattgattcccattttactattttgcaaaagtgctaattttagtatatattatgagggttattgaataagtttgacttgtttgagatttcacctaaatcgtggggtaaaatctagctaataactcatcacaaaagggatgaatagggttgaataagaggtctagtttcattcagtatatttattatatgctgtactgctattttgaaaatgtgactacttgaggtgttagaagtttagccagaatgcactagtgaatctattccagtctttgatcaaagtgtacttctgaaattcagaagaaccaaatatctatagaaatgtagattttggcatccaggggctatatttcagacagttttctgtctaatgtctatcatccatccactaattcatacatctacatgtccttttatccagcatttaccatgtgtgaactaaagcttcatgtaaatccatgcttaaactaagtattttattcaattctatctaggatacatgaacaccttgtatacactttataaatattaaaaattgtttctgaaatgtatttttaaagcttgggtattttcaaaattaaaataatattttaccatatataagtgtatatactatatataaaatatgtatattaacatgcataaaacaaaacagacttaagtttataaaaatgttagaagagtacacactaatattatatactaatgtgatttgagaattgccatatttgttaatggtaaacatgattaaatagcttaaatatttgcgacatgacatgatgacagtttagtcctatggaaatttattgacagacttttaattctcctgaattccttttgcaaagtgaatactttctaaatacccaggaatattttctaaagtttaaaaaaaatctgtggtgagatttgaaagttaaatacatggatgaagaggcatgataatgcagatggattatttttttctttgtacatcagaacttctgccaagatatgattttccagcaggtttattcacttaacccattatgcgcactatttctcaaccttctgtgctgcaaatcaacagtgttgtgatactgacttatgtactgtatcccataaacttcctataatggagctttgcagattaaacacaaaattcttcttttttggtagattacattttctctctccatttctttctcttttgcagttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggtaagtggatattggatctctaaactgtaaaacaccatcccatattgtgttacctacatagctgcctctaaaatattatagatcactttggaattatcagtaccttttctaccacagagataaatttatcagagtattactgctaaggctattccctttaaatttaaagtagaaagtcaagggtgaatggatgttaatatcacaacatatacacatgtatattgaccaggatgtcagatcacattacctgatattgacaggttagaagtgtggtttccttttcttgattcctttgctcttttccaaactcaacgtgatgtctgcattctacttttatcctcccatgataaactgcacaaaatgtcaagtctacaataaagatcacctaagaagggcacagttcattgtcttctgaaatgggagggcagcatcttaattagcatttaataataataaaaacaaaaaaaaaaacgctaaataaattaggagtctgctttggttattttcatttagggctaaaatctcatgtagtaataatactcatatgtatatggatttaccacatatagaccctattttaagtatttcacatgtgtcacattgtttacttctcatgactctatatagtaggccatactgttttcttcttttgtagatgacaaaactgaggcacagtggggttgttcagtgacttatccaagtttatacagctagcaactgacagagataggattcaaacacgggcaacgcaggttgaatcagaggctgtgttcttgctcataagtcaactgcctttcatattaaaacttagtactgagctggaagtggaaaggtagagtataatctcagcctatttgagattctatgttatcatgtgtaacattatgggagctacagaatttataaaagacatgcaaatccatatttgcaaatggattattttttctctgaacagacattaaaagccaccctactaacacctggggacactgagcgtttttctctaatgaggtttcctcatacttcagaaaagtaggagacatttcacttagatggggtatgaagggcttgtggctttacagttatactgtaagtagattatagggtagccaactagctgtgtgttcagaacagtggctcacccaccatcctacaagatgaagccttcagtccccgtgtagtgtgatccactacagtacactagttcgcatttaataataatgaaatcaggtggggcgtggtgactcatacctgtaatcccagcactttgggagactaaggcaggcacatcacctaaggtcaggagttcgagaccagcgtggccaacatagtgaaatcctgtctgtactaaaaattaaaaaattagccaggcatggtggcacatgcctgtagtcccagctacgtgggaggctgaggcaggagaatttcttgaacccaggaggcagaggttgtagtgagctgagatggtgccactgcattccagactgggcaacagagtgagactccatctcaaaataaataaataaataaataaataaataaataaataaataaataaataaaataatgaaatcaaagagtgccaaataagtgagcagtcctctttgttttattttatttagggcaaaaatctcacataataatagtactcatatgtacatgtgtacggggggaaaagcagaataatatgctctatgggtgacgttcttggcaagagggaatatggacattggggaggttttactctcaaaatcaaatcccctgtaaatatcggaaaaggagcccacagcaaatgctactggaggtcactgcagaacagctgcttagaaggccgtggctctgctctctgccccttgtcctaaatgtcttccttttattctgctgatcctaaaagttaaatttggaaaatatgtgattagcctctcaaatagggttgccaggttaaaatacagggcacccagttaaatttgagtgtcagatgaacaaactatattttttattacaagtatggtaccaaatattgtatgggatatagttatactaaaatgatttgttctttatctgaaattcaggtttaactaagggacactgagattgctttcactgttaaatctgttaaccctactctcagagcttcggtttaatcttaagaaagtgttaccacaggaaaacatgagggtcggattctcttgtatgtgatggtttatactttcagaaatacacgagagattagcatgctctgattaggaacatttcatttcctgtaggataataaatgcaaatagttaagtaggtgattataaggtctttggtattatcaaaccagattctaaactgaaaaaacattgggagactctagaaaaataatatttaaaatttccccaagtttgttttctaaaggacagaaagaataatcctttgtaaaagataaatagaccttcttaatattttcaactttaaaaagagaaaaacttattaattctcaatgcattcaagtgcttgtgatccccaaattaacctaatttcactgaaagtattaaggcttataccactaagtatataggattccttatgacattaagcacagaatatgtcttagagccatagaattttataaatggacttcatttgtcaccagtccagctgtctggtctaaaagaaatggagccctaagaaatgaaataattttccagggatatagctacccagcaggccgtgctgggattgaaaggggagtgtcctgaatcttagcacaattattttctactcgacagcttttccaatacaatttttagcaaaagagcttttttcaactataatcttgagtaaaccattagtctattaagtagacagaataaaggatcctcaaagatgtacacattctgattcctgaaacatatacatatgtgagattactttcaatggggaattagggttgctagtcaactgatcttaaaatggggagattatcctggattagccagatgggcccagtgtaatcacaaggatccttcaaagtggaagagagagtcagaagagaagagtcagtcagagatagacagactatagaaaaaaggcagaaagatgcagtgttgctggctttaaagatggagaaaaggggccaagagccaaggcatgtgggtggcctggagaaactggaataggaaaggaagctgctcctgcttctagggcctccagagaagtgcagccctgatgaccttttggttttagctttgtcttccagaactgtaagagacaaacttgtgttgctttaagccactacatttatgacaatctgttacagcagcaataggagacagatacagtatcgaaagccaaggtcaatttttttcccaaactgcttactgtttttgtgatctcctacatttacttgatcatgatggcagtccattttctgtcaaagccagcaaagttgcctctccctgacaattctgcaagcttaattccccttcacggcttactccaacacaggtacaagttccggagttaaggatgtgaacatctatgggaggctattttttgcctactgcagtctactctctggccaccaaagatacacatccatttctttgtgtgaaatacattcaacctaccccaagttccaaaggtttcatcccattatggcatcaactcaaagtcaaaaaccttatttcaatctcattagttcatacctctgattgtcttttttttttaaaaaaagaaaagaatgtgctatattatttctttctatactatgtaaagcataaatatgtggttaaaattattctttgaagcttaccaatgtttacaacatatttatcaatatttatccaaaggtaccttttcttttatggatttgaaagaaagagaaggcactttttagatgtcatgcagcctttacatgagctattaagacgttctgtttagctcttaatataaaatctattgctgtatagcatttatttgccctccagattatatgtcctgataagactcctgaatgtatgtatataaccacattattatcaagaagcatcagaagagaaccattcctcaaacattgtattaggatcaattcagaatttactaatattcatcaaaaagacaattgcatagataagaatatactttaatttcccttgttgcagagttgtctccttagtatatagacgctatcttttattttacaggagactaggtatttaatatgtaataggaactctcagcctataatggccattatacctacttagtggaggtatacatcttactgttcattcccatgcatgtaataaatttatgcatttcgaacagttctaatggcacacagagacattacttgatatagttggaggatttatagatagcatatcatattaggatttgctgtatttcaaactgctcatgaaataattttattcgtatttttgatgcttttattatgatttctgttatcctccaattatatattctgtgattcaattacattggatgtattagatgtttatccccataactttatgtgaggaaatgttgaaactgatcctcattacatcatctagatgtaaggtttaaaactttcctccattacaacctgaagacttgataaaacttaagagccaacacagagagaaagtaggtggggcttcttttagacttttagccaatcctacctcttattcagcacacccacgcatgttagcgagagcagcttgtttttatcttatttccataaagcacttctcagtaggatttcatttcatttatttgctcacactatttttgttgctgaaagcagggattcgatctaggtcacagtgctcgccacacagaaagccagtcactgagacagaaagtattgccaggaaggaaggctttttcaggcactgcagccgaggtggatgggagatcagtctcaaatctgtctccctaccactaaaattggtggtggggtcatatagtgaataaggaatgtaaaacaggaattaggggataaggaggtaaccatgaatgagagtctggcatctcattgtctagatgtggtgatctggtcagcttcagtcccttgcctgatggtgagtttcctgagggaggaactcagatgagacaaatgtaaatttcaagttttaagaccagcagggttaatttctatgtttgttcaaaaacccacaaatatcatttccatgggacaattgggttggtttcattttcaacaaatatttaaggaaaaattgtgtcatgtgctagtactgctcaattttgaaagaaaaatatcttcatgacaaaaatataaaatgaagtttgacacttacatcatgaacctggctcatcatactttctctagagaagacagccaagacctaggaatattccattatttgtccaagatgtaacagaagatagagttgaaactagaaataaatagcgcttttaacctaagtgtgtgctattcaaaaggacactttatgtttgcataaaaattagatacatatactcctaataggaattcttttgtatatctagctatgtgtcattgctaattactgaactatattcatttctgctaaataattcaataattcatttggtaaaatattggttatatttttcctgtgtaggctaagcctctgtttggtattcccatgttaggtgacatgtcaagggggaattgaagtcacagatggaattaaggttgctaatcaactgattttaagaaagtaacgagcctgaattatccaggtggcatcaatgtaatcagaagcatccttaaaaatgaaaagtagggccaaaggagaggagtcattcagaggcagatggactatagaggaagggtatgaaaagatccattgttgctgactttgaaaataaagaaaacccccctagagccaggggaagtgggtggtctctagaatctgcaaaaggacatgctggtattttatcatctttaaaattagcaacgtaaatgataaattatttttaaatttaagcatttatatttcatagtagggagttaattcctatcgtgctatcagacctcagagtgtcataagtatctgctcattctgcttaactccaactctcatttacaatttttgtttgtttgtttgttttttgagacggagtcttgctctgtcgcccaggctggagtgcagtggcgccatctcggttcactgaaacctctgcctcccaggttcaagcaattctcctgcctcagcctcccgaggagctgggattacaggcgtgtgccaccatgcctggctaatttttgtttttttagtagagacggggttttaccatgttggccaggctggtctcgaactcctgacctcaaatgatccacctgccttggcctcccgaagtgctgggattacaggcgtgagccaccccacccggcctacaattttcttaagaggaatttacaaccctaggagtcgcacttcaactgtccagtaagcaccaaaggtttttattgccttagtgatgaaagtcataggaaccgtgtacacacattacgcatcattttctctgacgttgttcatatttcaagtacaaataattctcacaattccagaaatatattacttgtgtttagctagcatgaaaaatataaggtactaaagaagcccgttactgcaactttcatgcatcaagtcctccctgttctccccaattctctttgcacccagttcttaatgcttctcttgcctagtttcagcttattatttttattatttttgagacaatctcactctgtcgcccaggctggagtgcagtggcgtgatctcgtctcactgcaacatccacctcccgggttcaagcgattctcctgccttagcctcccaagtagctggtgaccaccaccacgcctggctaatttttgtatttttttagtagagacggggtttcaccatgttggccaggctggtcttgaactcctgacctcagctgatccgcctgcctcatcctcctaaagtgctgggattacaggcgtgagccactgcgcctggcctcccttgcttataacttgccttttctcctaattgctttgaagaaactgaaaatatcagtctgcacctttcagctaaaaacttttccataggtaataaatatatatattcaatatttagaaaaattgatataaatttgaataatgttcttaatttttggtgagaacaatttggccattcatagacagatatatgagaatcaaaataatcaggttttcaaatttacactgcagctcatcctccacgtgctcccttctagagcttcatattattcacatgttgatttttaaactacagttaatttttaatatatattatatctatttgttatatatggtatacttatcacaaaaactttattttatgtgtgcgtgtgtgtgtatatatacacatatacatatagcatcaggagtactggaggttcagtaatgatgttagcagtggtacatccatatgggcctgcagcaacctcacttcttgcctcctcagaaggaagaattcaactgaggggcataaggcagagtaagataccggggcaagtttcagagcaggagtgaaagtctattaaaaagttttagagcaggctgaggcaggagaatggcgtgaacccgggaagcggagcttgcagtgagccgagatagcgccactgcagtctggcctgggcaaaagagcgagactccatctcaaaaaaaaaaaaaaaaaaaacaaacggaaaagttttagagcaggaatgaaagaaagtagagttggaaaagggccaagcgggagacttgagagatcaagtaccctgttggatcttttgacttggggttttatacattggccttcttctagggtcttgcatacttctcacctggttcttcccttgaggtgggctgtccgcatgtgcagtgggtggccggcacttgggaaggaccgtatgtgcactgtgttttctggagttgcacacatgctcatttgagtgttcctagaggaaggtcatatatcagttacactctgccattttgcctcttagtgtgcaggcttgagcccgcttctgcaactcctgagttcagatcaagaagctgccgatcaccagctacaggtgtttctttattaggagccagctgtgactaattattattttagaaagacagttaacaactacctgactgtcacctgatggtggcctgacatccttggtgggcggtgagttggggtctctcttgctctgctcatgtctgactacctactgtaacgatagtatttttttttaatgatgtagaaaaattgcactgagcagttgtcatttgaaggacaggagtagctcagctctgggaatattcttgtcagagagaagagccggtgctaagttaccaagccaatgtgatacctggtttctcaggaaacaacagggaagtcaatgtgtctgaagtagaacaagacagtaggacaaaagactgagatgaagtctatgagttcccacgatgtaccatcttgatgaatgcattacagaacattataggtgtggggttttattctgaggggagtagagagtcattacagattttggcagaggcaggagatggtctgactaataatagaaggattactctagctgctacttgaagaatggtttgtaggaagggtagaagcaaggaagccagttagcaaatgattgtattaatccaagtgggagattttggtggcttggatgaggagatggcaagggaggtgggaagaatcggtctgattatggatgtattttgaacatagaggcagcagaatttcctgatagattgcatgtagggtttgcgggggaaaaaagagaattcaaggaggaatttcttttgactgagcaaatggtaagatttgctatcaagaaagataggaaaggctatgagaagtgtttgcttgggagtggagccagcaaaggagaagagcagaagtttttttaaaatgcttattagaaatccaaatagaatggtcagatgagaaattggatatatgaatcctgatttcagaagagagatatgggatggccacatagatttaggagttgttgacagtatttaaatatctgggactggatgagatatgcatgggagaaaaaaggctgaggagtgaagggtgggaagctgcaacttaagaggtcagagagaagaggaggcaacagacaaaaatatgagaagaaggagccaatgagatcagaaaggcaaaaactgaaaactgtagattttagaagacaaatgaagagagcatgaaggaaaaggtgggcatcaactgtgtttaatactgtcaacttgcaagaagatgaaaactgagaattaatccttggaggtcattattatctttataagaaaatttccatggaggggggttagggcaaaatctgacttgagaggatttaagtagaaatgaaaggaaaggaattacagtgaggttaggcaacactttctaggtgttttgctgaaaacatgaattgagaaatgaataaggaaatgtaagcacaacataaatattccacaaaataaagtctgtaatggattactatgaagagagagagccttgaccagaagctttttcaacaatggtgattttttagggaggaaatctcatgagagaacccttttaaatttttacccactcttagaaccatcttggcagaaaggaaaggctgtagagagggatctctgtgtttgtttactgcaaatagatttttcacactgaaatagattccacaaactattggcaaaggacaaactaatagcagcagctctgtaagagagggagagttgatgacaccccataaagctaagaatatgtaaatacatatacatattaaaactaaataaagaaggcctggtaccgtggctcctacctgtaattctggcactttgggaggctgaggcgggcagatgacttggggtcagaagtctgataccagtttggtgaacatggtgaaactcgtctctactaaaaacagaaaaattagctgggtgtggtggcgggcacctgtaatcccagctactctggaggttgaggcatgagaattacttgaacccgggaggcgtaggttgcaattagctgagattgcaccactatactccagcctgggtgacagagtgagactccgtctcaaacaaaacaaaacaaaccatgaaaataaaacaacaataacaaaaacaactaaagagcagaaaatgctaaaatcttaggtattagaatgtcctgaaaatgttttatcatgcctgtatgtgtttagcacttcaagagttcagaaaataaaattaaagagccatgctcagatgaacttggttacttttgctctctaagatgagacaaagaggcgtgccagtgaattgcctctgtgctcgttttaaaaatgcagtgttctaggcctaatattcatagattcccatctatcagttttgtgttagagtctaaaaatacatatttttgacaacttcctaggtgattctaatgctgttggtctatgaaccaactggaacaagggtaaatagaagcgaaatggcaacttttcatttcctgttactaatagcattgtttgcaatattggcagaaaaaaaagtactcctttgggcagtatgcttttagagattaacagaagcactgcaccagctgaacaaatttagatcctgacttcagcacagtctggggcatagttaacaaaataattgtgatgcctatactatcacattaatgggccaaaccaataaactggctataattgagtctggaaattctggtggtgagattcaattgaattcagattgaaattatttaaattgcttgagggctaaatagtcttgcatattatattcataattctatgcatagttattatccacaatgaaagctagattatttttccactgtaacataacataagataaaatggaacttgcttagatttgattagcaaaaactcatttttttctctcttggctcttcaaaacatttatactgctaaactgtcatttcccacacattgtaggaattgtgacaattggagaggaaaagaaaatttgtactgtctctgagaatttcttgaggatgtgcgaatctactgaggtgagtgtttttacagcctttaattttgtcagaattttagcattcattttttattatttggataatgtattaaaactaaatctatattgacttttccctttattctatcagaggcaattttacctgaagtagtgttattcaggaggagtagaggataaataggaattagatgctctgcatatttcaataaaaattataataactatttcaaattttctggaaactcattttaatgaaggctgaaaacatgatgaagttgtttttaaagagagcatagccctccttatattgttataatgttactgatgaaaaccatcattattaatcattgtctcatctttataatgaaattatgttataatgatgaagttgaaaggatttaaatgatttgcaggggaaaatatattgtaataatctgttttaatcaggtgggtgatttatcacaggctcgcttttatttaagatgtacaaagtcttgtttataagacagtagcaatcttgacttctcttctacctataactctgacaccttttgattctctgtggtttccattgcagctgaacatgaccttccacttgtttattgtggcacttgctggagctggggcagcagtcattgctatggtaagacctcaaagcgctggtgcttggttttcaatgtgaattccaaagctatttgcttgtagagatgataaactatctctaaagtttgaagttcatgtaaaacacatttatgtcatcagattaaaaaaagtagggaaaacaatgggtaagtaagtcaacaacaagactaaaccccaagaaatattattattaccatattgagaacattaacaaaaatagtaattcattaggattttagatattagattactataaatataaaaattatttctgtagcatatatgtacataccaatgtgacattgtgagtaatctaatcaattccttgatttacttttttttccttagctaagaacattaaaaagccatatagagtcatttatgaaaaacaaattaggttattaaaaaaaacaaatgtcagtagtttcaagtcatgtcttctatatctaatttgcttcagaaatattaagagccagtctttagatcttcttttaagacatcaagcttttacacaatgaggaggatctaccacgtgccagagccagtctcctcctttctaacttggcatgagttccagtatgcccactggaatgccaaatatcaaccctgagcaagtgctctgagtgtcagtaatagcttttgcagccaatatcttcagtctttgtttgtatccttgaggatgagtagtctagagccctagaaggactcccagtaacctcacgactgtgacagccgagtcaatatgtaaagatggtgaatgaattggaatttatttaattattttcctcatggtgccaatatctatctaatgtattggtgaaaggaacactttcataaaaaaatgtttttctcttgtcagagactaaaaataagaatgatgagaaaatactaatgtgctaattagccatgtcagagtggttattttactgatttcataaatattttgtatttaatttgttttattaaaaatgacttacatatatattcaataaaactatgtcagtactaacatgaatttttgatgttttgttactttagcgttgctcaacatttttgatacagtgacctctatatagaataaacctctatatagaaattttgtttcagaacgtgagacgcttgataaggatcatgttggttgattaattggggggatcaaaatagaacaaaagcaaaggccttatattctcaacctaaaattaatgctaaactatgccctggggaagaatcagcaagttctggccaatgatataccaaacattattgtccttaggagaaaacatgctggttgtgatatcagaggaaacatatgtacccttgtgttcatacacccatttctatgctgtcaaaaactttaatgacacgggtatgtacaagcaatatatacccaggtacaagaagtctgtgaaggtatcttttaaaaagtggactataataaatatttgtttgcatttgctacatatatgtgcatataaaattctgtctaaaaatacaggtatacactagtgaaaaacacctatttagacaaatgttatttaaatgtccctgaaaatgcttactctcaaaacaaatcaacagattttgagatgatagaaatttatatattatgtatttcttaagcaatctatgctttgcatatacttaaagctatacgtacattttatttaaaacagaaagcttagaagattattttttcaagtactaagcattatttgggggttattttctctgtctagagtcatcacaaaaccccatactagcttaaatgattgacctaagtatttccaatttattagctctgataatgatgtaggtcttgggagacaggtaaaatataactactgctactgttcctggtactaatgctgctagtaccaggaataataaagcagggactttattattaataatatttcttaaaaacttaatattaaaaattgagaatagtaattgtaatgttattaataatatttcttaagaacttattctgttctactctactccattatttgtagagaagttaggaagtcctacatgctgacaaagtaaatcgacttagcattggaccagatttcagtaatcactgttcacctagcgagggacagtaataagccctgcagcttgggttccccttaaggccagaggaaatgcttgtaagaaccatgaggaagcacctgtttctgaattggagtgaccttgagtttcagtatttcattcatgcatatatgtatatatatatatataatatataaatattatatataaatagattatatattttatattatatattatatatttttatatataatatataaatagattatatatttttatattatatattatatatagattatatatttttatattatatattatatttttatataatatataatatattatatataaatatatataatatataatatattatatattatatatatattatatatattatatattttatattttatataatatataatatatatataatatatattatatattatatattttacataatatataatatattttatataatatataatatatttttatataatatataatatattgtatatttttatatatataaaaatataaaggttttatatatatataaaggtcatatatatatgaggttactgggagtccttctaaggctctccatatatttttatatatataattatacatttttatatatatactatattatattattatatattatataatatattatatgttatatattatatatttttatataatatataatatataatatatattttatattatatataatatataatatatattttatataatatataatatataatatatattttatattatatataatatataatatatattttatattatatatgatatattatgtcacatataatatatgatatatgtcacatatatgatatattatatgtgacatataatatatcatatataatatattatatattatatatcacatataatatattatatatgatatattatatgttatatatttttatattacaaatattttatatataaatatattatatatttttgtattatatatatttttatataaatatattttttatcttatatatatttacatatataaatatatataaatacatatatatatatatatatgcatgagtgaaatactgaaaagaaattcaagatcactccaattcagaaacaggtgcttcctcatgtatgtaaaatatatataatataaaaatatatattttatatataatatatattatgtaaatatatatatgtatttttttgagacagagtctactctgttgcccaggctagaggagagtatcatgatctcagctcactgaaacctctgcctcccaggttcaatccattctcctgcctcatcctcccgagtagctgggattacaggcacgtggcaccacacccagctacgttttgtacttttagtagagatggggtttcactatgttggccagactggtcttggactcctgacctcaagtgatcaacccgccttggcctcccaaagtgctgggattacaggcgtgagccaccgcacctggcctcaattatacatatttaataataatttgggggccacattttctcagatattatgaaaagtttttgaagattgaaaaatacattcatttatttggcaaatattttgtgtatctgctatgtactaagcactctccacagcacttgatattttacagcaacaaaatactgcataaacttcattatgtgtataagccttatttaatccatatatatatgtatatatatatatatatatatatatatatatatatatacagtgattatgctttcactatgtaaatgccataatgtacaagaatataactcacagcccctgctttcaggtggcttacaatattccttaaacaaaatgctaaacttcagaggaaacagaaaattctaaaaataggttatttatagtggtatgcatcttttcccctacatcccgtgtcaaaattattttgttttttgctgtttgttgactacctgaacacaccacaatattcattatttagaattgacattgcattctttatatccatctgtacttttctagaaccagcccgcctcctctttcaatgtactgtttactaattatcaaaatcttagtgttctatttttctgaatgttggattaaaatattgcccaccctttaaaactcagagaatgtaaataactgtcaacttagtttctcttccctattcatcaaaattcatcatgtggaaagctgctttatctcccctgtggaccaagagggaagaaagaaaagaaaaacaaataagcggtctcattgctgggtaaactcaagtcaaataaaggagctttatttctccagcaacttcattactcaagacaaaccaggagcttcctttttgaacatggcactattccagtttttgtgaatgtatatacatataaaaaatccatgtaacacaatattttatctcctgtagtttataaccaaaaagaaactacaaaattcatcatatgcaaaattaacctgataatcaagtccacaggtatatttgggggtttccatgatctctctttaattggggtaatagaacctccaattaattcaagtcagttagacacaacggtatgtgaaaatatttctgattatggattataaaacatagatacatgaacatgaaatgaatcatctatggtttgggcaaatgaggacacattgggcaggaaacatcctataaagactaagaattagttttggattacttccaagaattgaaaaggagaaagagatactgaaagaaatggtgccaagaatatggtgggatatagttggaggaatgaaaatatattttatattgtttctgttaccaaagaaattttgtttccattttatatgtgaacatttcctataaagagctataattcgaagacttctttcgagatagcaaggtgtaatgaagacactgaacaaacttccaatataaattatttttctctttgattaggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaatctttgtacaatgactagtcatgcatcatcagtaattttacaagttcttgtagtaggtagggggtactactagggatatctgtggcatgattatgcattccgtagtattatttaattaatttggggttcattttgcttccttttctttatgcttagattatcttactggttcaacatttttctgatatatgcagtattacagatattcagcaaaagtattaatgggcttctttaaattctatattatagtatttcagttccgtgtcttaacagtttgtgataatttctaaaactgtcttttcaacttatgtaatgatgttgacacttttggcttttatttctggtattagagtttgtattttcacagagtgctttgtagcaggcattacaattaatctgttttgtacataaatgtgccaacagcttgatggtggcgtttttgaaatgtagaacagagtgcttgcaaaatgtaataaatacacttgtgtactttgtgtacttattatt

SEQ ID NO: 37248 - DNA, 369560 bp, Homo sapiens; identical to SEQ ID NO: 37247

SEQ ID NO: 37249 - DNA, 29440 bp, Homo sapiens
ggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacaggtaacgcccccgcggcggccgcggctcgggacactccctggaggcccagcggccccaagacccgcggcgcgcgcttccggccccggcgcgccaggccgaagttcccgtggcgccgcgtgggccggtgcatggcgctgggcccgggcggctgccgggacgtcgccgcttcccagggcggcgccggcgcgagaccgcggggacgcgaagcagcgaggtctcggctttccgcctgctttaagccacgcggaaactgctgcacccttgactgcactcgttcagctgttcaggcgtcgcgattcgtaaatataagaaatttcccgctctcttccacggcttcccagaacgctgtgtcgctaacaaccagtgaagacccaagggctagggtgcagttctggtagccgggcaggaaaccagggccagatttgctcaccctaaaaacgaagtgtgagggcttccagtggctggctctgcttggagcccagagacattttcatccaatctgtattttagcgcctcgtatcagccaggctaaaggctgaaaagagatttgctactgaacctctcttaagtctccctgcatcgcctcgtacataatacaagtgaggtgtactggggactgcggtaactttcttgcctctgtcaccccgtctttgctgacacccagttccatcagttctttgctttcagatggtaatgttgattcctaattccctgtgaacctgcagagataatcgccttaggtcttacttctgtagttctaggtaaatccattcgatggcttgtttaccttgattttgtgaatgagtagaagtcactacccatatatatttttttgattggagatagtgttttactgatttaaattggtagccccataatcctcaagtctgctctctggattgtgaaatactcaggttctcacgtgactgtgggtgatttcctggtgactaaatacagccttacctttcccaggccactcccccaggctctaggtgtcacgtcttaggtcatgatttcacttgtatttctccctgtataatggacacaattactagcattgcgcattggatgccacagaatctctgctgtcaacagctgatcattatagagaaataaaaagtgaaaggaagggccggcgcggtggctcacgcctgtaatcccagcactttgggaggccgaggcgggcggatcacctgaggtcaggagttccagactaacctggccaacatggtgaaaccctgtctctactaaaaatacaaaaattagccgggcgtggtggcgggcacctgtaattccagctactcgggaggctgaggcaggagaatcgctttaacccaggaggcagaggttgcaatgagcggagattgcgcccattgcaccacagcctggacaagagcgtgactccatctcaaaaaaaaaaaaaaaaagtgaaaggaaaagaatataagtgaaagtgtttaagagaaattttgttacactgggtaggtagttcacagaaatttctgtaagcactcactgttgtcactatacagttattttagcattgcttattaagtagtcattgaatgccgcctgtgtgctgtggatgttttaagtgcttatctcatttaatcctccaaatacccttctaaggttggtaggtaataatactgccctgattttataaatggtgaaactgaggccccaataagtaactttctgaaggtcacacagctattaagtgctccagccaatgttacgacttaggcagttgtcagattccagagcctgtcttattaatgatcacctgcgccacctcttgagtaaattaatagtacttatttttatcttaaaatgtcaattcctagtattttgttactcaaacgttttaaaaatgctgactgactcaaagaatcttactagaccaatgagttagattgatttctaagttaaaaatactgtgaggcagggagcggtggctcacacctgtaatgccagcactttgggaggccgaggcgggcggatcaccaggtcaagagattgagaccatcctggccaacatggtgaaaccccatctctactaaaaatacaaaaattagctgggcttggtggcgcccgcctgtagtccttagtcccagctactcgggaggctgaggcagaagaattggttgaacccaggaggcagaggttgcagtgagccgagatgacaccactgcactccagcctgggcgacagagtgagattccgtctcaaaaaaataaaataaaaaaaagtactgtctacttgctgcaaaaacttatttttctacttataaaactttaaatttgaaaactgttgattagcttttcagcatctgagggttatttgttttaattttactttaatagtttaatgtgtaaaacatattggcaaaacttggtcatgaagaatccaaccatgattacattatgagccctgtaagttattaatatcaatgtaactgtaattattgtcattttaaaaacactagagtcccttttcttctgtatttgaatgtaaccactggttggggaatgtctgttttcagggacagagcagaatgggctgatatagatccggtgccgcagaatgatggccccaatcccgtggtccagatcatttatagtgacaaatgtaagtttgtttatattaggaaaaggtctgtaagttaaatatagtagcagaattggaattcacaactatgtagcaagatagatgacaaatttctgtctaataaaaatctgaatgacttaagatgagttaattttgtgttttttttatgtgtgtgtgtgatttagctttatgattaaaagttttattttgcccaaagactggacatattctaaataataaacgttacagtatagtagataatagctactatgtgattgtggttttcttttctttgctggagactccaccgccagggagattatgcatgtaccacacaatataaatgagttactgtttttagaataaactttggttgctgaaacatcaggatttaaacatatattttggcagtgaagtgttcagctcagttggaatacatttattgatattaaaatgagtggatttttttctttgacaaaatattcttttgtaatgaatgtgaaagtgtaaattgaaggtcgtggaaatgttaattgttagttcttctaggaaagggaaaatgaataaaatggaatgatagttttgtaattttatgtatatatatttctttcagttaaggcttttctaagatcattcttttacaaaagcattttttttctgctaataaaatgacaataaatgtttaaaaaagcataatgataggtttgccgtattaagtgtgcagatatattactaaacttaatgattaagtggaagtagcacagaagtagatttgtaaagactcgagaaatagatcctcactctatgaaagcttaatatgtgataaaaaggacattttatacctttatgaaaagggtggattaatcaaataatggttggaacagttggctgtgcacttagataaaagcagagttgtatccctatcattcttaggatggagaacgtattaggcaagatgtaaacctcagaatcgattaaggagaaggtcagaatatataactgcacggaaatgcaaaactctcatactttgagagatagtatatatgaagagacaattcacaaaatagaaatatctatgaagagatattaaccttactagtgatcagagaaatataaaccataacttattcagattcataagtacttataacagagatgttgggggaaactaatataatcatatgtttccattgaggataaattaacctttttgcaaggtataaaattaacattttgggccaggcgcggtggctcacgcctgtaatcccagtactttgggaggctgaggtgggcagatcacctaaggttaggagtttgagactagcctggccaacgtggcgaaaccctgtctctactaaaaatacaaaaattagctgggcgtggtggcaggcgcctgtaatcccagctactcaggaggctgaggcaggagaattgcttgaacctgagaggtggaggttgcagtgagccacgatcacgccattgcactgtagtctggacgacaagagcaaaactctgtctcaaaaaaaaaaaaaaaaaattaactttgtgaattcttacatacaccatggttagaaaccctaaaggaaaagataagtttgacctgtcaaccgtttatagacaaatatatcaatttaaaacttacacagcagaagaaaccatgagcaagttaaaaagcaagcagcagtgtggaagaaggtatgtcatttaaacaggatccatattaaaactgagacgtttttacaacaggataaggagacagagagtttaatcaaaaaatggacaaagggtatgaactggcaattcacagaaaagaaaatcccattggccaataaaataggaagaatcctttatcattaagaatgacaggttaaaatgagaattccattttccacccatgatttaagtggcagaaatgaaaactgtcttgatattatattaggtattaagatatatgaagagctccatacatttcatatgggatttttcgaatgtttagccattttggaaagtagtttggtatatctgttaaaactggaaaatgcacttatcttacaacctagcagtgtgttgcttctaatttaatattgggttcattctggcacatggcatgagaagatatgcacaggaggttaaaagcacagactttggagccagaccatctggttcaaattctaacttcacattttactgactgtgtaatcttggacaagttatttaactcctatgtgcctctgtttccacctgtgtaaaatgaggatcttggtagtaactatagatgtagtaaattatttacataaaatagtagaatactgtctggctcatagtaagcactatatatgttagctactataatttgcagcattttttgaaaaagcaagatattggaagctatatgtctatcttttggagaaatggataaaataaaatgtatcattgtcatacagttaatactatataaccgttaagaggatttagatctattataacatgaacagatctcagaaacaatgttgagttaaaaaagtcaaagtttgagaatcttcgagcatgacaatatgttgtttataattttttttttttgagatggagtttcgctcttgttgcccaggctggagtgcaatggcatgatcttggctcaccgcgacctccgcctcccgggttcaagtgattctcctgcctcagccgcccgagtagctgggattacaggcttgcgacaccacacctggctaattttgcatttttagtagagacggggtttctccatgttggttaggctggtctcgaactcccgacctcaggtgatccgcccacctcggcctcccagagtgctgggattacaagcgtgagctaccgcgcctggtctgtttataatgtttgaattaaaagaataatgtttcattttaccttttacagtgaatcggattttggttgtttacataggaacctgaggctttggagctatcccagcctgatagcctcccagtttattttatcaatgtgcatatgtgtatgttttatgtgtgtgtgtgtgtgtgtgtgtgtgtgtaagataatgtattatatatatacatttgtatacatatttaatatgttaccattttgttttaaatttgaaattatttggaagcttggttttttttttgagacagactttcgctcttgttgcacaggctggagtacaatggcgtgatctcggctcactgcaacctctgtctcccaggttcaagcgattctcgtgcctcagccttctgagtagctgggattacaggcatgtgtcaccatgcccagctaatttttgtatttttagtagagatggggtttcaccatgttggtcaggctggtcttgagcttctgacctcaagtgatcctcccacctcggcctcccaaggtgctgagattacaggcctgagccactgctcaaattcaactttttaaagatagtgtttagaactaggtaaactttgtatacctcagaattttgtgaagaggagtaattgttcatattcgtgtctgatactttcagtgttacaggctaaaaggaaaaaactgtttctctatagtcaaaatacttcgacaccaaatgtttggatttttcacaccaagcaattttctgtagacaccaactagttgccctacaatttaattcagttctgacattacccagagttagcacagatcccacaggccaagggatcagtgctgcaacatccatcccacttcagatgccattgcaagtagtgggtcaccacattacccacatttaatattctacttggctgtaaatgacccctttctgtttttttcttttcagagacaggctctcactatgttacccagcgtggtctcaaactcttgggctcaagcagtccttctgcctcagcctcccgagtagctgggagtacaggtgcaaaccaccatacctggcagttccttttttttttttttttttgagacagtgttgtgctgtcacccaggctcggtgcttgcgatcatggctcactgcagccttgacctcccaggctcaagcgatcctcctacctctgcctcccgagtagctgtgactgcaggcctggatcaccacgcccgattaatttctatattttttgtagaggcggagtttccctaagttgcccaggctaattttaaactgctgggttcaagtgatctgcctgcctcagtcttttgtttgttttttttgtaatccaatgctcccaataaatatccttgaatacttgcacacatatgggagtatatttgtgagagaactttctagagctggaattactgggtcaaagagtatgtaaattttaatgatttgttgtagaagtatttgtactagtttacactatctttaataatgtacgagtgaaaaatgcaaagctcagagtgtgatgggatctcgtttgcataaaaatgaaggatggaattaggctatatacttgtagatgcatagactatatttggaaggatacactagaatgagttaataatggttgcttctggggaggaggcttgggaatttagtggaatggaaatctagtgtgaacctttttgtactgtttgagttttctgcctttgggcatatttttcagttaaaaatctgatcaaaatgtcagaaaaacagctatatgaatatatttgaatatatgcaaccctaatttttcttttatacataaggcctatgggagatatggaatctggcatgaactcatgcacacacgtaagcagtaagcatacagttatacataaatagtccatgctttttgtggctgaggcactagggcattattagggtggcggccacagccatttgactttattttgcttgttggtataaatgatacacaggccaataaaatatctttataggtatagtgacattatacattatagtgctaattttaagtaagatggtcctaatgtagttgtgtgctctatctctagttagagatgtttatgattacttccgagctgtcctgcagcgtgatgaaagaagtgaacgagcttttaagctaacccgggatgctattgagttaaatgcagccaattatacagtgtggtaagtaatacacatcatcagtattccctgcttaaatgttttacttcaagtggcttttctttttttaaactgtactttaatttttttaaactgtactttattttttttggaggggggtgcagtttcactcttgttgcccaggctggagtataactggtacaatcttggctcactgcaacctctgcctcctgggttcaagtgattctcctgcctcagccttctgagtagctgggattacgggcgcccaccaccacgcccagctaatttttttgtatttttagtagagacagggtttcaccatgttggccaagctggtcttgaaatcctgacttaaggtgatccactccccgcggcctcctaaagtgtttggattgcaggtgtgagccactgtgcctggcctttaatttttatcaaaatagcaattcgcttatgggtttaaaagtcagaagctgcatgaaaagtagcaatctctagcccaatattccctcccactgccagtcccactccgcagaggtggtaagtaactcttagtgatttttttcttgaattaacctccatattctagataatttgcttaactgttattattttttcattttattttattttattttatatttttacttttattttttttttttgagatggagtcttgctttgtcaccatctggagtgcagtggcacgatcttggctcactgcaacctctgcctccagggttcaatcgattttcctgcctcagcctccccagtagctgggattacaggtgcccgccaccatgcctggctaattttttatttttagtagagatagggtttcaccatgttggtcaggctggcctcgatctcctgacctcgtgatccgcccacctcagccttccaaagtgctgggattacaggcgtgaaccaccgtgcctggcttatttttttcatttaaaacattattccttctgtgaaagatagttcattctccactaccctccctccatcacaaatgagcactcaatttatgttcatgctgacacacttttttttttttgtttgtttgttttgagatggagtttcgctcttgttgcccaggttggagtgcagtggtgcaatcttggcttactgcagcctctgcctaccagattcaagtgattctcctgcctcagcctcccaggtagctgggattacaggtgtacgccaccacacccagctaattttgtatttttagtagagacggggtttcatcatgttgctcaggttggtctcgacctcctgacctcgggtgatccaccagtctcagcctcccaaagtactgggattataggcgtgagccactgtgcacggctgctgacccacatttaatagtataatgacattccctctaacagtgtcatttttgttttctttgtaccaataggtaatttgtcgtccagatgctctgctatatgtgaagtatcatttttctattgaacacaggtcatccttcagtttcatttttctcttcaccaattggatgctgcatacctggttttcagctcattcatgtgttagatcccctgtgtcctagatcgtatacctttctctttcttgatttactttctcattttatagagcacatcattgagtagaaagatggaaaataatttttgggatttatacaattaaaaatcattagtctcccttcaactttagtaataaaattgtagattggaaattattttccctcagaattttaaaactctttttctgtttctcttagcttcttttcaggttgagaagatttccattcctttgtttaaaacttttctttttctctttatgttctggggatttttctgggttcttctgataatttcttctctttcctctgttttctttttctggaatgccttttagttctatgttgtatctcctcaatttttcttattttcatttgtttatctttttattttcttttgagataatttcatcaattttattttctaactctcgtatggatttttaaagatttctgcattcatttttaatttgggggagctgtttttttgttctgtgaatatgcttttttttttttgagacagagtctcgctcagttgcccaggctggagtgcagtggctcgatctctgctcactgcaagctctgcctcctgggttcacgccattctcctgcctcagcctcccgagtagctgggactacggacgcctgccaccactcccagctaatttttttgtatttttttagtagagatggggtttcaccgtgttagccaggatggtcttgatctcctgacctcgtgatccgcccgcctcggcctcccaaagtgctgggattacaggcgtgagccaccttgcctggcctgaatattcttttttaaatagcatcgttcgtgtgtgtgtgtgtgtgtgtgtgtgtttaatttcatggatgtgagatcttctcatctcttttgttctctttcatataaatatttttctcaaatggttggtaattcttgactttctctttatgcgtataagagagacaggaaaaatcctgattggaagccctgtgtgtggcaggatttgtcagctgaagggcttcgctgtgaagttactgagtggggatgtggctgtgttgtagtgaaatctcactagtcagtatttaagtcttttctcttggacagtgtgtctctcaaagaggattaagtagtttattgcctaaggagtgtacatttaactgccacagttctagggtgttaggcaggggaagatggtaggagagtctcactgtttaggataccaactttttgctttttgcagatcttatcctgttgtaatttgaaatagaaacttttttttctaagtttgtatatcaacattttaaatgtccttatttccaccctttaactcaccctgccttccagtgtgccttgtaacccattctgcttcagatttttccagagaataaagccacttgtctcctgcccaagacaggatgtcacttctgtcatggtagtgggaacggtcttggccgccaaggactctttatatagactttccactgtttttagtcccagttttggaaatacgtcatacctctgatttctggaattttcttaaagtcttattctgtgttttagttaaatcttgtctatctgctcacacttcccataatgttgttgacctcttccagttgccgtggtatctttgccccgattctctttgttcttgtgggtttattcctttgttgtcattttagtggggttttattagggagtgagaataaacttgtttacttaatctaccctgtttaactggaattctcagtgtgtttcatcatttttggaactgacagtacacttaaaagatttcctgtgagtttattgctgttttgaaagaagcagtatacctggaatccttacccataaaagccaagggcttatatttacatgctctgggaagtctactttttttttttttttggaataataatggagagaaatactgttgtctctcctatttagcattttattttattttatttttattaatttttttgagatggagtctcacgctgttgcccaggctggagtacggtgacgtgatcttggctcactgcaacctccgtcaccggggttcaagtgattctcgtgctgcagtgtcgcgaatagctggaattacaggtgtctgccaccacacccagctagttttgtatttttgtttgtttgtttgttttttgagacggagtcttgctctgtcgcccaggctggagtgcagtggcacaatcatggctcattacaacttccgactcccggcttcaagcaagtctcctgcctcagtctcccgagtagctgggactacaggcgcatgccaccatgcccagctaatttttttgtatttttagtagagatggtgtttcaccatgttagccaggtctcaaactcctgacctcgtgatccgcccacctcggcctcccaaagtgctgggattacaggctaatttttgtatttttaatagagatggggttttgccacgttggccaggctggtctcaaactcttgacctcaagtgatctgcctgcctcagcctcccaaagttagcagttcattttaaaagctaataaaattaggtcctggaatgtcccttactatatatcgagttggaaatttttgaaattttgaagtaaaactagaccagaactaacgacgtctttaggaaaattccttttgttggtggtggtggttaaaactccacctatggggaaattaaagacaaacttgtttcatttacaagtagcatttttgtggttgttctagaagtattttgttaatgtttataatagaattaatttattatatggataatgtatgtacacgaacaacgtgtactgtgtagggaaagagatgtctttgattttcatattatagaacataggtgaccagagtagtacctgaaaataattttagttggttggctgtcattacttaagaatcagaaatttacttttcttctatctcatacttgttacctttcactatttttttctttttgagacagagttttgctcttgttgcccagtctggagtgcaatggcgtgatcttggctcactgcagcctctgcctcctcggttcaagtgattctcctgcctcagtctcccaggtagctgggattacaggcatgcaccacctcgcccaactgattttgcatttttagtagagatggggtttctccatgttggttaggctggtctcaaactcctgacctcaggtgacccacctgcctcagcctctcaaagtgctggggttacaggcgtgagccactgtgcctggccacctttcactatttttactaaaagtgcttcatttcttccagtcaccagatagtccactcacaagcacttaaattgttaaattatacagagtacctatgtataattttttttttgggtgggggtggatggagtctccctctgttgcccaggctagtgtgcagtggtgtgatcttggctcattgcaacctctgcctcctgggttcaagcaattctcctgcctcagcctccccgagcagctgggactacaggtgtgcaccaccatgcccaactaattttttctgtatttttagtagagacgaggtttcaccacgttggcaaggctggtctcaaactcttgacctcatgtgacctgcacacctcggcctcccaaagtgctgggattacaagcatgagccaccgtgcttggcctataattgttaaattatacagattacctgccaaaaatttgtctaactgtattgctgacttgtagctgtatttgatattgttattagggaacttctgtgtaataatgcgactttggatgttgtatgtttgccctaggcatttccggagagttcttttgaagtcacttcagaaggatctacatgaggaaatgaactacatcactgcaataattgaggagcagcccaaaaactatcaagtttggtaagtttggagtctagctgtgtctcccaggctggagtgcagtggcatgacctcggctcactgcagcctctgcctcctgggttcaagtgattctccagcttcagcctcctgggtagctgggattacaggtgcacgcaaccacacctggctaattttgtatttttagtagagacggggttttgccatgttggccaggctggtctcgaacttctgacctcaggtgatccgccctcctcagcctcccaaagtgcagggattacaggtatgagccattgcgcctggcctagaattttatttaaaaactaccactgtagccaggtgcagtggcttctgcttgtaatcccagcagtttgggaggctgaggcgagcagatcacttgagttcaggagtttgagaccagcctggccaacatggtgaatccccgtctctactaaaaatacagaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaattaaaaaactaaaaactttaccattgtagcctgttgattacaagattgttgtatttctaagaaattacattataaaataattggtttaatgggaaaagagattaaatggagagttgcagaccctcactaaagttatttaccctgtggaattaaggtgcttttatgtaaaaatctgtagctataaaattctgacatcacaggcattagtgtttgattacatcgagtttttgctaaagagaaattgcttttcttttctggatactgcacactgtcattagcacttcatcacccactgttatgtaaaacacaaaaccactcaaagtagctgctatggaaagcccagcagttttgaaattgttgtacatttctaattatccgctctgttcgttttataaccagtgtagtacaggcgatgcaaattctgtatcccagttaactaatcacttttattaacttctaactgaaaacttatgctataacataaagccgtgtaactccttaaatccgagaacatcagcatgaactttttcttcctcagtttgatatcctggaggatctgattcttagcttttctaaattactgaactcaccagcaacctggaaaaataaaatccagctagtgttcactgacttggaagatttctaaaataaatttggaaaccttctgtctaggcttttgtttttggtagtatcttgtcttaatctgtaagacgaattttttaattttccaggcatgtagaataggtcattcattaagcattaaatccttccctttttcctattgttctgctcacttttagttgaatgttatactctaatatagattttttaagggtccgttttattgagatatagttcacttaccatacaattcccccattcaaagtatataattcagtgttttttagtatatatacagatctgtacaaccatcaccatagtgagttttagaacattttcactaatagatttatataaatatttcagccaaagaaaattataaaaatggaacccaatataaaatccttaagtattttcctagcgcagaaactcctggccgggcgcggtggctcacgtctgtaatcccagcactttaggaggctgaggtgggcggatcacctgagggcaggagtttgagacctgcctggcaaacatggtgaaaccccgtctctacttaaaatccaaaaaattagccgggcgtggtggcaggcgcctgtaatcccagctactcgggaggctgaggcacgagaattgcttgaacctgggaggcggaggttgcagtgagctgagattgcgccattgcactccagcctgggggacaatgcactccagcctggggaacaagagcgagacttcgtctcaaaaaaaaaaaaaaaaacaaaaaaactcctctgttgacaacttgcaacttgtcatagctacttgccagtgtagcagtaaattcagttctgcccactcatttgtagaatgagaagctgcttgtttgatgacactttgcacttagggaaaattgacaggcgtgtgttaagtagaggaacttatatatttgataaaataatagcacattttgtcttgtctctcattatacaatctagtaatgtttcttaattttttgacacaatttcatggttgttgaaagatactaccagatgtagtttgagataaactatctgaattttttttctattttttttgtgttaccttttctccacagtggagtgttaagaattagagatgaatttttgtttattgtgtgtcctttcatgtcacctttacaacatgtgcaactgatattttagttcatgggtaaattaacaaaaaacttctctcccttctttgggctttaggcatcataggcgagtattagtggaatggctaagagatccatctcaggagcttgaatttattgctgatattcttaatcaggatgcaaagaattatcatgcctggcagcatcgacaatgggttattcaggtattgcctttcttgtacagtgtttttcagattttttttttaactgaactaaataaaattactcttaaagtctgtttctaaaccaaaacacacacatacgtagatcattgcacccaatatataactaaaaattattggccatgtgtggtggctcatgtctgtgatcccagtactttgggaggccaaggcaggaggattgagtgaggccaggagtttgagatcagcctgggcaacaaagtgagacccccgtctctacaaaaaatacaaaaattagccatgcatggtggcacacacctgtagtcccagctgcttgggaggctgaggcaggaggattgcttgagcccaagaatttgaggttgcagtgaactatgattacaccactgcagtctaccctgggcagcagagtgagaccctatctattttaaaaaaaaacaaacattattaacatacttaaaacctgacatccttcatgttagctaacctttataatctctttggatgtagtaaatttttagtattttttagattgaatttgtatcatatttgctagcaaattgagtataaagagtagcatatttttactacagatgtattattttaactaacaaaggcatattatacatttttttcatatataaactttggaataggattttacagtaacttaagttttttatttctacccatgtgtcaaagttttatgctaaattctgaatagaatagttgtaactcccactctgggtattttatttattttaaacagttctagtattgtttcctgtgaattttttccagggattgctactttctgcactattcattagaccaagagcatttcaccaaatacttaaaacttaaaaatttttaaacttttccaaatttgattaaaaggataacatattctaaaggtattcaatatttttacttatctctgaaaaacttaatcacataaaagcatacattttacacatacagctctctccatcttccacaatagattaagacataaaacataaccagtatttttgaaaagcccccttaactggcatgcttcttactgaaattatcataaaaggttcgtatgagaaaggattccagaatatcccttaattgtgttgtagcttatgcatttctatttattttatacattatttaattcatgtgagttacttacctggcagggaagatatgatcaccaaggtgcctttcacattcattgcactctggatgtgctgacccctgcaatttccccaaatgggggaagctcaactgcataatttgtgatagggggactgtgtggcactttcctctggtcttcgtggtttaagaacaggttttctctgcttatttttattaaaaaaaaaaaaattatgtgagtcagtggttctcaagcagcagtgattgtgccccctaggggacatttttggttgtcagaacttggggcatgttgctattggcatctattgggtagagggccaggatgctgctaaacatcccaaaatgcacaggacagtcccccacaacaaagaattatccagcccatactttcagtagtgtcaaagccaaggaactgtggtctatttctatatggaaaactattttattaatatttcagttattttcaatgaggatttaatgaattcagcatactctttgatgacctaaaatgggactatgagatctctaaaaaatatttcatgacatatatattaaaaacgtggtaaaattttagttttaaacgttagttttaaacatgaattataaacattcatggcctgtatgtcattggcattgactgtactagagcttcttaaatgaaggagtagaggacccttctttgtccccaaccgatcacagattggatgtattttactgtatttcatgtatatctcatttatataaaatacactaaaaatcaattactttaaaaatgagtctgggtacagtggctcacgcctgtaatcccaacactttgggaggcccaggcaagtggatcccgtgaggccaggagttcacgactagcctggcaacatggcaaaaccccgtctctacaaaaaatacaaaaaaatgagacgagcgtagtggcgcatgcttgtgttcgcagctactcaggaggctgaggcaggagaatcacttgagcccaagaggtggaggctgtggtgagctatgctcacgccaccacagtccatcctgggcaacaaaatgagaccctgtctcaaaagaaaaaaaattaaaagtgaaatacacacacacacacacacactactactcaccagtcaaaagaaatgaatgatccataccggcaacaacttggatggatctcaagggtatgatccttagtggaaggggaagtctcaggtttcatactgtatggctccattgagataatatccttgaaacagcaaaattatagacgtagagaacagatcagaggttgccagggtgagggaaaagggggtacagctataaaggggtagcatgaggtagtttctgtgtgctgagggaatagttctccatcttgattgtggtagttatactatacatgggattaaattgtgtagaattatattctacccccactcctccacctgtcccacatacccacaagtgagtacatgtaagatctgaataaggtgagcggttccattaacaataatgtacagatgtcattttctggttttgggattgcactttagtaagatgtttaccatttggggaatctaagtgaagggtacacagggcactgtgttatttttataacttccatgagtctgaaaacaaatagaaacatatgtatagaaaacactactctttgtttttcattattagactctacagacattaaattgttacattgatacaaaagcttgtaggtgtttactctctatccttagcatgctggagactgagaacagtgggaggacaccaatcagtgcccacactaggcactagttcctgaactccactaggaactttcacaaaaatgttactttccttaatgcgtttatttttatgatcacctgtaaaatcggggactatcataggagattcttacttttttgctgttaccaaataagaaaactccattatcttttttataatgtcccctactttcaaattatttataagttttttttatcattttcctcttttaaattatctttattggttctcttcccccatttttttttattaagagagctttataatataaaaaatttatattgcctgggtgtggtggctcatgcctgtaatcccagcactttgggaggccgaggtgggcagattacttgagttcaggagttcaagaccagcctggccaacatggtaaaacctggtctctacgaaaactacaaaaattagccggttatgttggctcacacctgtagtcccagctacttgaggagctgaggcaagaatatcgcttgagtctgggagttggaggttacagcgagctgagactatgccactgcactgcagcctgggcgaccaagtgagacgctgtctcaataaaaataatagaaatttatatctttgtccaattgtgtatatttcttttctttttctttttcttttttttttttgggacagggtctgtttctgtcgcccagagtgcagtggtgcagtcatagctcactgcagccttaaactccggggctcaagtgatcctcttcagcctcctgagtagctgggattctaggcatgtgccacgatgcccgactaatttttttatttttattgtttttattttttggagacagagccttgctctgtcccccaggcttgagtgcaatggcacgatctcagctcattgcaacctccacctcacgggttcaagcgattctcttgcctcagcctcccaagtaaccgggattacaggcgcctgtcatcacacccggctaatttttgtgtttttagtagagatggggtttagccatgttggccaggttggtctcaaactcctgacctcaggtgatccacccacctcgacctcccaaagtgctgggattacaaacttgagccaccgtgcccggactgtctttattatttttccagacaagatcttgttatgttgcctctgctggtctcgaactcctggcctcaagtgacctttctgcctcagcctcctgaagcagtgggattgcccatgagagccaccactattgaccatgtatgcttctctccatgtattttaatgtaattttatcatatgtgcacttttgaatgctacccttttacttaattttcatttttgaatgctgcccttttactttgatatattaatatcggccaggtacggtggcttacgcctgtaatcccagcactttaggagcccgaggtgggcggatcacctgaggttgggagttcaagaccagcctgaccaacgtggagaaaccccatctctactaaaaatacaaaattagccaggtgtggtggcgcatgcttgtaatcccagctacttgggaggctgaggcaggagaatcgcttgaacccaggaagtggaggttgcagtgagctgagttcacgccattgcactccagcctgggcaacaagagtgaaactgcctcaaaaaaataataataagatatattaatatcaagtcacatcaaatttatatctatactgtggtcactccttctcttactagtgagtttggggtttttttccctcaaaattttcttggatgtcttttttcctgctttctgtatgtgtctttccaggctctatcatcaatttcatacttgtatccccctctatttcctttacttgcagctatcactaccttctgaatttgtgataaatcctgtgtcctcagttctaccttctttgttgtagttttaatttattttttattcataaataatgggacatttctaattggatgatttttctaaatttttcctttaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagttagtaatctccttcacttgctcattcgttacaaacatgtttgcatgcctaccatatctcaggcactggggatacagcagatcaagatcctaccccatggaactaaaagaggacagagtactgagtggaacataggatgatagatttacaaataatgtagcatacttctacttcattgtatcttaagtttcttgaaatattgctactggagattggaaagaaatcttaatgttatggggtattgtctaagaagctttattttaaaaccatctcattaaattttgttgcattttagataatcgtccccagatgccatgttaccctagtgcagagtttggggctggataagtttttgttgtaggtggctatcctgtgttttgtagggtatttagcagcatcctggccttaaaacaaaaatgttttcagacattgccaaatgtcccccgagcggtaaagtcacccccaagttgagaaccgctctatacaaagagctgttattagagctagacatttctgaattggcatcaatttctatattgtatccataaacattagtagccacgatttttgtgaccttatttgtccattgtgtctgagtgtctgttttacaatttgaacaggcttgttgttttcagagcctgatgagatgggagtcataattttagtgtaaatgtgtttgaacaactgttgagtggagctgatttgtatagtgcatctcctctcttccaagctcttgattttgcctggatcgaggcagcttgctcttcttttatctgctctatacaggattctggtgacttaaaatttataaaaggctttaatccatgtctcaccttaacactctgctctgggcttttgtctggagcgtgcactacccctcaagcacacttcatgctttttttctagtgctctcctatataaagctgtacaggcatacctggttttttgagccttgtatatattatgttttttttttttgtttgttttttgttttttttaacaagttgaagcatcttgagcaatcttgagttgagcatgtcttcattgccattctttctaacagcatgtgctcacttgtgtctccgtgtcacattttggtactcctcagtatttcacattttttcataatcattatatctgttccagtgatttgtgatcagtcatctttgatcagtcatctattgtaattgtttgggggtgccactaactgcacccatataaaacagagaatatcactgttgcatgtgttccaccatctctctccctcacctcaggcctccctattccctgagacacaacaatattgaaattaagccaattaaccctacagtgtcctctgagtgttcaagtgaaaggaagagtcacagcctctcactttaaatcaaaagccagaagtgattaagcttagtgaggaacacatatcaaaagctgagataggtccaaagctaggcctcttgcaccaaacaccaaactcataagaaagagttcttgaaggaaattaaaagtgctgctccagtgaacacctggacaaaacagcattattgctggtatagagaaagtttgagtggcctggataaaagataaaaccagccacaacattcccttaagccaaagcctaatccagaggaagccctaattctctttaatttgatgaaggctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctgtattgttcagtatggtagctactagccacatatggctatttaagtttcaatcggtatgattataaaaaattaaaaatacaattatttcattgcacatgtcctattttgggcgttcagtacgtacatgtggctagtgactaccatattggacagcacatacaaaacatttgcatcatcactggcagttttattgaacattattcgtctaaagattgacagtagttagcggtaacaaagcattttaaaaattgaatatgaagagttttcaaaatgcaaacgtttagccttttcagaggcagatcactggcttcctgttgccaaatagaaacagaaataattacccaagaatctaaaagagcttcctatacttaggatttattttccttttaagatgggtaaaagaagtatttaaaatgtgaagagtagctgtaggtatctagaatttacagtttgttaaattttttttaactctaagcatacacagatagatgtacataattatttttgtcatttttttctttttattataaaagtaatgcaatgtagttatggggggggaaattgtactaaattctataaagtaaaaagtcaaagtcttttactgttcttcatcccacatcccattttccagagtgagctataattgggtgaatttttccaaactttataaatacacttgcaaacatttatacacagcaacctagataataatgttacaggcattgccttttcagttaatgtgtcatggccctttttctagactatgagtgcatagtcttctagtactaccaataacagcatttatcaagcatttactatatgccactaattctaacagctctgtgagacacttcatgaagaacttgaggttccaggtaattctgtaatttgcccaagagcacataatttatgggaccaggatttgaagcgaggcagcctgacctcaaagttcatcggtctttttgtttgtttgttttcctaagagacagggtttcactctgtcacccaggctggagtgcagtgacggatcatagctcactgctgccttgagctcctgagctgaaggaatcctcccacctcagcctgcgagtagctgggactacaggcatgtgccactgcatccagctaattgttaaaattttttgtagcgatgaggtctcactatgttgcccagactggtcttgatctcctggcctcaagcagtcttcccgctttgatctctgaaagtgctgggattacagatgtgagccaccatgcccagctaaagttcatgttttaaccataaaaataggtaatgctttagtacacatgtatgtaaataaaaatttagatattgccaaaatgaaattaagaatcttaaacaaggaccagctaagacctgcggggacatggtttcgcaaataattggaaacattaagtcatgtaaaagtagttggaaaagtatttttataatgttgaatgagtttattattactctgtggaaaaaaaaaaattatagtaacagcactgcagcagaaccaagactaccaagctttagtcagtgacttactcatctgagcaattatgtggtaaagcaagttctgtggcttccttgggatttgtgataattgagtctgaattatatttaatctgtttaaggggaagataaaggtatggagcacccattttgacagggaatcacatcacagtttactagtcatcttgctttggaatataagaaatacattcttgtgttgatttttcatttttattctttgcctatgtaatttccatgccattttttaatgatagctaaagattatgtaaattctcctatttcagtgactagggatttgttgggacgtaagtagagcttagactgtttccccaaggttgctttaccaataaatggaaagtttccttcttttagctgatgtttccttcaaaaggaaaatcttccatattatttaaaggaaatattttatgttcctttttttcctattgtgaattgaagcttttagattagttttgtgtccttccctagaactgaattgacagctgcagccttaagggattctcgtgatttaaatatgactgagagaggtgccacagtacactaagaaacgctgacacaagtgaaagtgtgtttacaaagctgtgccacagtcttagtaaaactgtgtcttggccgggcgcagtggctcatgcctataatcccagcactttgggaggccgaggcaggcggatcacaaggtcaggagttcaagaccagtctggccaatatggtgaaaccctgtctctactaaaaatacaaaaattagctgggtgtggtggtgggcgcctgtagtcccagctactcgggaggctgaggcaggagtatgacttgaacctgggaggcggaggttgcagtgagctgagattgtgccactgcactccagcctgggtgacagagcaagactccgtttcagaaaaaaaaaaaaactgtgtctcatcattgcactgttcttttaaaattgtatatatatatttttcttgcagatacactctggaaatgattaaactagtaccacataatgaaagtgcatggaactatttgaaagggtaagaggttgtttttgctttttttatatataaaaaagaagtggctatatgatgcatcatggagtgtattccataatcagattccaaaaggatagtaaataatttttcatttttctgaacctaagagcagaagtataacagcattatggaaactctctgggagtttgcccttctatgcacctcccaagtacctaccaacactgttttcagaataatccaccagtaaataatgccattttaattgtatttaagaatcctgtagtctttatatcaaagaatggaacacacacacccccaggctctagttggctcaggaacacagtaaagcggggtagtttacaggtagattttgccagtgggcagccaacctttctgttttcatttctagagatctccgccttcaggttaacctactcctcaactagaaaaggtttcacttgcctggccactgacgtaactaagctccttgttgaacataagaggtcttcaaggaaactaggctcaaagagcacaaagtatggaaccagttacccttggagatgtgtcaggggaggtgcctgtagtatttggagagctcgagggatgagaagccatctcaagagaagacgagggctgggcatgttagctcatgcctgcaatcccagcactttgggaggccaagatgggcggattacttgaggctaggaggtcgagaccagcctggccaacatggcaaaaccccgtctctactaaaaatatacaaattagctgagcatgttggtgcacacctgtaatcccagctacttgggaggctgaagcacgagagttgcttgaacctggaggtggaggtcagagtgagccaagatcacaccactgtgccccagcctgggcgacaagagaccctgtctcaaagaaaaaaaaaaaagaagaacatctctcctggttttgtccttcactttttaagatgatttattttgtgtgttgtacagtttaagttataaatgaacacttttaaacttcatttttaaaaactttttctacttagcttgtaattatcctttttttttttttttttttggagacaggatctcactctgttgcctaggctggagggcagtggcatgatcgtggcccactgcagtctcgatctcctaggctctagtgattctcccacctcagcctcccaagtagctgagactataggtgccaccactaggcatggctgatttttaaaaaaattttagtagagacgagatcttgctattttacccaggctggtcttgaactcctgggttcaagtgttcctcctgcctctgtttcccagagtgtttcccaggcatgagccactgcacctggccagctcttaattaactaatgatctatgataagactcatgtaatttaaaagtttcattatagtttcagcgtcattcattcaaaataactctccttttcttgtttgtgtttcagggtttattttctcttgatctttctactgcttttgttcttccttcacaaaatcaagtctttgttttttgttgttgtttacaggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagaggtaagctggtggggctcagtgctgtcatttttggtatctcagaattgatctgcccaataccactaatatccatgtcccctttcaacatcgttcctcagaattcagtgcagggctatttctggttaggggcagcattgacatcacttggcaacacagccggtgactcttaatagtgtgtcttcatttgaatgtgatttgagttaaattgtattggctcaaaggcatttgcgcttgaaattgaattacatattactttaatttttatttttcattttcagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatct

SEQ ID NO: 37250 - DNA, 57061 bp, Homo sapiens
cgcccccttgttcccgcaagcccggaactgcccaaatcccgcccctcccctcccaaaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggataggtgagtggggcgggcgcgcggcgcggcgcggcgcttccgtgcggactgactagggccgtcccggcgtacggggcgagggaacggaggtcgggctcctcttgccggagtcgctgcggggccgcctgcgggggtggctgcagggagtcggccctagattagcagtttgaggggaaggcgccgaggtgactggcctccaggggggaatcccctagacccgggtcaccgtcttggcgcttttactcttgatttcgctgtttgggcttttagaaggcagtctgagaagaatgactttgggactcttaatttaaaaatacgaaagaggctcacccctgtaatcgcagcactttgggaggccgaggcgggcggatcacgaggtcaggagatcgagaccatcctggctaacacggtgaaaccccgtctgtactaaaaatacaaaaaattagccgggcgtggtggcgggcgcctgtagtcccagctactcgggaggctgaggcaggaaaatggcgtgaacccgggaggcggagcttgcagtgagccgagatcgggccactgcactccagcctgggcgacagagcaagactccgtctcaaaaaaaaaaaaaccaaaagaataccaaggctgttacgttgccttataaatgaagcttagcagaatccaacatttgtagttaaaacagaaaggcagtctgttgcttttggagtcgagtggcgcagaaatccttccttcgcttcgcccacgcgtggctccttggcggccacctgagggggactggggctgcaggtcagcccttagcaagtctgacttcgggagccaaaaccgaattcctgctatcagccaggcagccgcactgctttccttctggagaagtttatagttacacgaatccattttcatagaacagtttttcagcaatttcaggctcgtgtctccttaaagcatatgctgcccaactttggctaattctttccgctcttgttctaaagacgtggctttgaagcgcatccttccactgtactcccccgtccaggactttgttcaccgtctagataccctctgttgtatcggtgaaccttataaacattctagaagcaaactaacaaggtagagtgtgaaaggaaaatcatctttacagtggtcggactcttgtaacagtgtgggcggcgcattattagctgtagccctttttgcctcatgttaatcttgcttgaacttgcagttaacccagatgttctggactttgtcaaattaaatctcttactacctctcctccccatgtgtgaagtataaattgatcatttggatttaagtctagagctttaagtttcttaggatttattttgacgggcttgtctgccttttagctttatattcggccccccaaaattcaccagctttctcagcttcgggccacccccaaatctgccaagcatactttctgaatcttcattttaaacagtctaaaccgttgataataaatcgacagtttcatttctatagatcatgcgttttggaatatggactttatgcataatatgctataattagatcacgtagatcatcctgattcataagttgccaggttttcttcacagaaattgtttttagggagaaactagaaaaatacaatgaaaatattgtttagaattaaaagccatatacctttttattttctccaacttttcgatgacatctaaatttaatgtatttatctcatttgtgaatatatatatatgcaatgttgattgcattagaaaatgctgctcaaaatacttaataaaatgcagatgtaaactagcttgattcaaaggttctgagtctgcattttttatcagcctgcttagatttcttcagagccattttttcacctatgctcccacagttccttacacaatgagattacctagtgagagggtcataagtgagatggaaagagagcctaggtctaggtcttggaattccatcattcaatggcggattgtgggagaggcaggagataaatgagagattgtaagatgtcaaaagccaaggggacatggtgtttctcaggggaaaaagggcttgcctgccagtatctaaagctgcagagagctctaggaaagtgagaattgcaaaatgtccactggatttaacaatatgaaggtcaaaactgactttagcaagagttgccattatggagtaatgggtgaaaagtcagactgcactgggttgaggagcgtagattgaggaaaaggagagagctagtaaaatgagcaacagggagatggtacagtcaagagttttattttttgtgttttttgtttgttttttatgttttttaaccgggagagacaaacaaagttgaatatgcaggagtaaagaggtaataatcagtgaagcaaggtatccgtagagggaatgagatctaagtcgtggaggagaggcgatccttttaaaggagggtaatttcctttattatactgggaaggaaaaaacaaggattttttagatttgggaaagtagagagcgcaatctgcttggactgaggaagaaggtagagggatttagtttaaaggagtgtgggaaaaatttaaagaatcattttggactatgggagacaagtgttacctacaaaatatagtagaaatgctgcagtgttgggggtcaatttaagactgatgaccacaaatctgtggtgaaaccaatatcccgtgggactttctccagcagtccacagccaggaagtacattgcatgatggaggtaatgtgctgtagaagacagataggagagaggggtttgggatttaggctttgagatttcaagatgaaaacaagtagacttagatttaggggcagctccctaagaaggaaggtgggcattgaggcctggtacctagagagtatggctcacccagtctggggtgaaatctcccagaagctgcactccaagcttacttgcttttattattagcacattacctccatcatgcaatgtaattcctggcaactgacccaggtcttcctttctcttccattttccaaagtttcagctgtgtcttttgggacagctgcgccataatcagcaaattccattgtatctttatgtcgttagagggttcccgctacttgcttgctttaactcaaaccttattaatttattcacctattgtgaaaaatggagaaactgaggcccagcaagagtccataacttgactacagatagaaactttttttaagattgaattctgctttaatctcttaatgtggtgaatcacattaataggtttcttatataaacccaaccccccttggtcatgatgtattatccttcttgtatactactgggtttgatttgttagcgttttatatagaagctctatttagtttccatagattaggtctctttttctctaaggtttgataactgttagacgacatgccatccactgatacagcagccttatacagtagacttaagagaacaacattctcagagtaaaaccttatgagaaatatctatttgcctgaatgtttttagaaagctgggttttctttccacttctaagtggcagtattgtaatagtttcattgccttgatcttcctccatttacccatgacggatatcaattttatacttacaggtagagaagcaattcagaatgcatgcctatcatgccactggaatccactaaaatggcttgtgggaattgttggaggaagtaccttcagaataacctaagattcactcatatattctttatatttatcaaggacctactatcattcgtcttttcaaacaactttttaaataactgtttctaacaactttaatttactgttacaaactatgcttttactagtgactgttatccagaggattctgaaatttgagtagttcctagattgaaatactctggattttatagctgctagaaatggaactttcactttctgaaatttaatgctcttgactaaattaaagccttatttttttaattaagaatattcttaaagctctctagtttaaaatgatgtgaatataaatttgtgtaggaagaatacatttattagaatgcctccagtgatgagagattatatcatagaaagaaaacttgaaagaaagcaaactcacttatcaaaaatgtttacttggattttacgtaagcttatgatacatcagctagctgtaagtgtctgatagtgatgtacccatcatatatttattcctcttctcaatttttcttttatttaatagcatgtttttggcccagaggagcctctgctctcttagcggtagagcaaaattcctgaagacaatttcttcttccaaaatcctcggattctctacttctgctgtaggtattgcttacttacagataaattattgtacatattctgcactgtccaaaaaatatgtaatttttcagatgcttttttacaaatactttattgaaatgaacatttctattacatatgctgaaggtgtctcttgtcattgactagaattgacattcactgagcaactgcttgcctgtctgtggatcaggccatgtgctggtcattatatattcattacctcattttgtcttcacaaaacccttcaagttatgaatataggtccagtggcatgggaaaaaagtagaagaggatatttcaggaggactgctcagggatcgaaaaaggtttaaaacccataaccaccaaatacaatacgtacatctgctttaggaacttgattcagtcaaccaaaatgcagaaagacattttttaaagacaatcagagagatacgaatgtggactgggtattagatgttaacaagaaattattgttggtgaggtgtggtaatgaaattgcagttatataagtagcaatattttttagataatatgccaagtatgtagggatgtaatgacctaaggtctaagatttattctaaagttactcagcaattacagaaaaaaagaggcaaaatcttgagaattactgaatctgggtagtgtgcatatgagtgttttatattaggttaaagtatatgaaattgctatttttgtatgaaaattccatttttggcatatgaagtaccatttttgtcataactggttgaatattgacaattttgtattcaacctaattctaatctctcaactggtttaaaattttctcagtggtttaaaattttcataaaaaccatcatcagtgtcttctatatgtaaatcttatgaattctacctcataactgtcttgaattctctcctctttatgccaccgtgaccacctttttcaggccctctcccaacatagaagtcggttgaagccagggaagtggttgtgcttccccaaggtgaacatatgaaaccatggcactaaaagggcatttgtgtgcacaatcctcatttgtggaacttttattagactacgtatgccagggctcaccattatgcattctaattctacatatctggaatgtattttgaaaaatctttccagctgattctgatgtatgtcccaggcaaaaaccactgacaatgcattattcaaacttgtggactatttgggatagcactaacccctctccatacctagcagtggaatggttgggttgtgtggtagctttatgtttaattaagtaactgccaaagtgtttgtatcattttaactacattggaaaagtgtctacagttcatcagaggctttgcatttaaaatagtcgcacagggataaagataaatattcttcctattgctggacgaatgaaaaacactggccagtgttacaaaagcaatagtgataagtttaaatcaagaaagacttgtcagaaccagccagataagttactgtgaacttacttagaatattcgtttcatccacatcatccttaatgtcatgaaaatctgccgggaagggaatagaatgaaggataggctgtattttcctgtattacttgcttttttacaaaaacattttacatattctctaattttaaagaatgttttgaatgctaaaggaaaaatgtaggcggggcgcagtggctaacacctgcaatcccagcactttgggaggctgaggccagtggatcgcttgagaccaggagttcaagaccagcctgggcaacatggcaaaacctcatctctattaaacatacaaaacattagctgggcacacacctgtagtccaggatggtctcaatctcctgaccttgtgatccacctgcctcggcctcccaaagtgctgggattacaggcgtgagccaccgcgcctggccctaaaatagtctattaatttttttttttttaagagagtctaaaatttaaatgtccaccagagaagcgcaaaagcaacactggacaaaaccttttccttaggtctgtccttccttaaggaaatcaactctctctgtctctctctctctctcttttttttttttcatacagtctctcactcttgccgcccaggctggagtgcaatggcgcaatctcggctcactgcagcctccgcctctcgggttcaagcaattctcctgcctcagcctcctgagtagctgggactataggtgcccgccaccactcccggccaatatttgtattttttgtagagacggggttttgccatgttggccaggctggtctcaaactactgggctcaagtgatccaccctcctcagcctcccaaagtgctgagattacaggcatgagtcactgcgtccagcccaaccctctcttttgatgtgaaagtatcaccttttgtacatttagtccatacccaatatctctttgcctcctttagtgcaaagttactcatccttacttgtatctaagagaatctttcctactttctgagtgggcactagttttggagtatatatattgtatgccatgaactatatttttctgcttatggctttgcctcatttaattgccatagcacttacatggggcaggtattcattttcctgcttagcaaataaggaaactgaatttcagagatgtcaggtaacctgcctacttcacacactaggagttttgatgtttaattttgaactaagatctatctggcttgaaagctctttgcattaaacaaccttgaacaatatacttggaacgtaggtgtgtttttggcacagaacatggcatgtgtgtgagggattgaacacagacttgcccagattcaaacttaccaatcttctgtttcatgtgcccagaagaaacagcctgtttctcagcctcaaacccaaacttctagttgtcttgattggttcagcctgactgtccaactctgatttatagctgtgattgggggagctgagattacacagtgtaggcaggcagaagggccccaggcctattgatatgggtgaggacaatactcacgcactcccttcacttactcactcttccaaggtcttggcttgaacccaattttttttgagagaataaaccaggctttttgttctccacttggcctgactccatttctggcattccagccatgtatttagctgttatcagctttcagatttagagaaagccttgtttccaataagcttgtttctctgaagtaattgttaaaatataattttcagaaaaaggttaaatcatgactcatacaaatataaaaatgaacatgtgctaaagatttttatttcactcatgtgatatgaagtaaccagacagaagttataaccagtacatatggaaagtcaaaaagcacaaattcatatgtagtaaaggaattggattgcaaatgaaggcaaaactgttttttctacagggtggagggaagataatcaaaatgctagaaccagaatttgcatgcctgtcacttagcttcaatttacaaaagcccagaataactcaaaggcaaattctagccctgcaaatatcagccctaaagctgtgctgtggccagtgcatagttttctattgaagtacaattttttccccaaatacattatctctcagagggagtccaaattgcttccctttcactcagcagatctgttcagtcaacagatgttaaatagctacagcgtatcaggcacaaataattctttataaaataaagtaacaaactatatgttgtttcaaagttccagttaaggccagccgtggtagctcacccttataatcccaacactgggaggccgaggcaggcggatcacttgggctaggagttccataccagcatggccaacatggtgaaaccctgctctactaaaatacaaaaattagccaggtgtggtggcgcatgccggtaatccaagctactcaggtggctgaggcacaagaatggcttgagcctgggaggcagaggttgcagtgagccaagattgcgccgctgcactccagcctgggcaacactgtgagactcctgtctacaaaaaaaaaaaaaaaaaaaaaaaaaagcaacaaaaaaagggctcctgttaattatacacacttttgagcttaatataattgcattttttatgtatctttaagcatctttccctgctttacatttccacttctgagttttactttcatttcttccaccattacaggaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagacacatgttcgtaaatacttttctttcattatatggctcagaatctggcaactttttaagagatacttgagcccactgaatgatatatagatcttatagtttttttaagtcaagccttaataataattaacattttttgagtgttcatctctcagtccctctatggccatgaaggtgggagatgtgactctgtttagtctcaagtaaagaaatgcaaactgagataatgggtacaaatggagatgaagcaaagccctgtgatgttcaagttcctggtttctgttaccattcagtctggctggacctctgcctttcccatggtaacatgacctttctaatgaattctcccttttcatctaaactgtttcagattgagtttctctcacataactaagagatctgattactatagcttcggagcttctaaggcatcttatgcacttgtctcttccccactgttcaatctgaagcatgtactctgccctttagcaaaaatcacaactccaccaggtgtggtggctcatgcctgcaatcccagcactttgagaggccaaggcaagaggattgtgtgaagccaggagttcgagtccagcatgggcaaagcaagaccctctctacaaatgaatgtttgaaaaaaaaaaaaattaaggccgggcatggaggctcacaccaataatcccagcactttgagaggccaagacaggaggatcacttgaacccaggagtttgagaccagcctgggcaacatagcaatattctatctctaccaaaaaaaaaaaaaattaagaacaaaattagccaggtgtggtgccacatacctgtagtcccagctactcaggaggctggggtgggaggatgacttcaacttgggcaggtgaggttgcagtgagccatgattgcaccactgcactccagcctgagcaacagagcaagactctgtctcaaaaaaattaaagttaaccaggcatactggcacacatatgtcatcccagctacttgggaggctgaggtggagatcaccttagccaggaggttgaggctgcagtgagccatgatggtggcactgccacagcctgggtgacagagcgagaccctgtctcaaaaaaaaaagacaccacaactccacccggagaagaaataaaatctcaaagaagcatgagcagccaacacaattttatagcaggaaagaaaaagcaaaaaagctaggaaagaacataacagtttctttttaagatctgtgtttaaacaaagacacttaggaagtggtacaagtgctaaggaatgaattaatactaaatgtcatcactgtgatggttggaacatcaaaatatacataacatatacatacatgtgtatattatatacatatatacatatgtgtatatattatatacatacatatctatatacaatagagttatgcttcacttaaaaactgggatacattctgtgatcatagagtgcacttacacaaacctagatggtatatagcctgctacacacctaggctatatggcatagactattgctcctaggctacaaatctatacagcatgttactgtacttaatactacaggcaactgtaacataatggtatttgcatatctaaacatagaaaaggtacagtaaaaatgcagtgagataagaaaatggtacacctgtgtagagcactttccatgaatagagcttgcaggattgctctgggtgggtcagtgagtgagtagagtgaatgtgaaggcctaggacattactgtacactactatagactttatgaacattgtatacttatgctatactaaatttattaaaacttttttctgccaagtgcagtggctcacgcctataatgccagcactttgggaggctgaggcaggtggatcacctgaggtcaggagttcaaaaccagcctggccaacatggtgaaacctcgtctctactaaaagtacaaaaataaaggaagggcacagtggctcacgcctataatcccagcactttgggaggccgagtagggcagatcgcctgaggtcaggagttcgagaccagcctggccaacatggtgaaaccccatctctattaaaaatacaaaaattagctgggcatagtggcaggtgcctgtaatcccagctactcgggaagctgagacaggagaatcacttgaacccgggaggtggaggttgcaatgagccaagattgcgccgttgcattccaacctgggcaacaagagcgaaacgtcgtctcaaaaaaataaaaatcaatttttttttaaatacaaaatttagctgggcatggtggcacgtgcctgtagtcccagctactcaggaagctgaggcaggagaatcgcttgaacccgggaggcagaggttgtggtaagccgagatcgtgccactgctctctagcctgggcaacgaagtgagactccgtctcaaaaaaacaaaacagaacagaacctttcttcttcaataataaattgaagacaattcacctactgtaactttttaccttataaactttttaaatgtttaatctttgactcttctataacacttaacacacaaactatacaaaatatttaaaaatattttatgtcattctataaattttttctatttttagtaattttctttttttacttttttgtgttaaaaactaagacacatacgttagcctagacctaccgatgaactggatcatcagtatcactgtgttctacctccacgtcttgtcccactggaaggtcttcagggacaataacatgcatggagctgtcatctgctatgataacaatgtcttcttccagaatgtcctgaaggacatgcctgaggctgttttatagtcaacttttttttaataagtaagggtacactctaaaataacaataaaaggtatggtatagtaaatacataaaccagtaacatagttgcttgttatcatatcaagtactatgtactgtacataattgtatgttctagacttttatatgactggcactgcaataggtttataccagcatcaccacaaacacgtgactaatgcatcatgccacaatgttacaacagctacaatggctccactaggcaagtaggaactgttttttttttttgagatggagtctacctctgttacccaggctggggtgcagtggcgtgatctcggcttactgcaacctctgcctcccgggtgcaagcaattctcctgcctcagcctccggagtagctgggactacaggcgcatgccaccacacccggctaatttttgtatttttattagagacagggtttcaccatattggccaggctggtctcgaactcctgaccttgtgatccgcctgcctcagcctcccaaagtgctgggattacaggcgtgagccactgcacctggctgcaagtagaaatttttacctccatatactcttttttttttcttgagatggagtctcgctctgtcacccaggctggaatgcagtggcatgatcccggctcactgcaacctccacctcctgggtcagacgattctcctgccactgcttcctgagtagctgggactacaggcacttgccaccacgcttagctcatttttgtatttttagtagagacggggttttaccatgttggccaggatggtcttgaactcctgacctcaggtggtccacccaccccagcctcccaaagtgctgagactacaggcatgagccaccatgctcggcctgctccatatagtcttatgggactaccgtcatatatgcaatctgtcattgaccaaaacgtgtttatgcagcacatgactctgtgttgtatatataatgtaaagcttcaataaaagtaaatcaaaagttaaatgtgtttagtttgatagaaccagatgactataatattgaggatattatccttcttgtgataattagttttgttacaatacagcactcaccttccacgtgaaactttaaaatgcaggggaaaagagcagagaccatataattaaaatgcacagtagaaacactgaaatgtggggctgggcgctgtggctcatgcctgtaatcccagcactttgggaggccaaggtgggcagatcacgaggtcaggagatcaagaccatcctggctaacgtggtgaaacccagtctctcctaaaaatacaaaaaattagccaggcatggtggcacgtgccggtagtcctgtgtccggaatttattccttcctgtgggttcttggtctcgctcgcttcaagaatgaagccacagacccttgtggtgagtgttacagctcttaaagatggtgtgtctggagtttgttccttcagatgtgtccagagtttcttccttccagtgggttcgtggtctcgctgacttcaagaatgaagccacagaccctcgggttaatgttacagctcttaaaggtggtgcggacccaaagagtgagcagcagcaagatttattatgaagtgtgaaaagaacaaagcttccacaccacggaaggggacccggacaggttgcccctgctggctcacgtggccggcctttattcccttatttggccctgcccacatcctgctgattggtccattttacagagcaccgattggtccattttacagagtgctgattggtccattttacagagtgctaattggtgtgtttacaatcctttagctagacacagagtgctgatttggtgcgtttacaatcctttagcaagacccagagcgctgattggtgcatttttactgaatgctgattggtgcatttacaatcctttagctagacacagagcgctgattggtgcatttataatcctctagctagacagaaaagttctccaagtccccactcgacccaggaagtccacctggcttcatctctcagtcccaggctgaggcaggggaatcgcttgaacccaagaggcagaggttgcagtgagccgagatcatgccactgcactacggcctggccaacagcaagactctgtctcaaaaaaaaaaaaaaaaaaaaaaaagagagagacaccaaaatgcattgcaagacaacaagacactgaaataacatgcccagcaacaggggaatgaatgagtaaaatatggcacaaaaacaaccaaaaacatacgttgtaattaaaagtgaaatttttatgactcagaaaattcataaaatacttaagatacagtactttgttaagagacaattaaaaatatttttaaatgacacatgattgcaactacaaatccccacttcatagatctaaaagacagtaacatttgggccctccagcatccaggccccccatgaaaagggtgcccacttctgctctttcctggtcccgaagtgtggtatccatctgtttcccaagcctggttctgttttcacctctccatccatgagctttgcatttcctatttctggccttttcttgcagttattattattgttactaatattaaactttttggctgtgaccttgacttctctggatgaagacttgattcacagcccatactacacagatatccacagcctcaattctcccagcttcagcccatcatttaggaagactttttctgtacctgtcccatctcacctgcctcagatcttatgggaagagtcctaaaaatatatacaattgaaactttgatggactagggtcttaagatcatgggttcaacatacagtattagtttttttcgatctgtccaaacttttttaaagacttaatcttttccttatctttgtcaagcttgccacctggtggtgaatttctagaacttcattgttctagaaattagcctcaagtgagcataagtaaggttaaaagatgctacctttgatttcactagcagttttgcgttaataacatggaagtataggcctttaatcaccctggtagccaaagtcatatcacagggttagctgatccagaagttatacaagccttatagacattcccttacttgcctgggactcatgccctgattccccgtaggattctaggttgattttaattacctgatactggatctgctctgggaagtagttcttacttagacagtgagcatttgcatctactgcagaatcttggtgactccgaacattgtatagtgtcttgtaaactttcaccagtgtgttagttccctcaggttgccttaacaaagtactacaaactaggtggcttactaaataacagcagtttattccctcattgtttgggaggctaaaagtctgagataagtatcagcatggccagttccttctgagagctgtgaataagattgttctataccccacccccactatcatctggtgattgcctggaaatctctgcattccttggctggtaggagcatcaccttagtctgtgccttcatcttcacacagggtctatgtatatgtccagatctcacctttttataagaccaccagtcatattggattagggttcacgctaatgacctcatcttaactaattacatctgcagtaaccctatatccacataagattacatccggaggaactgggagttaggacttcaacatatgaaactaaggggggcatggtccaacccatagcaaccacgtatctcattatacctccagacttcatttccaccatgtttttcacaattatttgctgctgttccctgctggacagttacatttccttgccccactgatgtgaagcttagctgtgaaattgctctgcccaataaaatatgaaaagaagtgatgtgtgcacatcctaacagaaccttttaagagcctcttccctctgccatgaaacaggcagtgttccaggtgaaggctgtttcatcagcctatgtctcagaatgacagtgacacagaccagggcagcagctgaacctcagtggatatgtagtatgaacaagaaaacctttatgattttaggccaccaagactttggggtcatttatcactgaagcataaacgaactttagctgactgatagagctaactgacaccataagttcaccctgtaatgtgagtgaggtttttttaaaaaaattcattcatcagataattatttgaaactatgtgctaggcataactatatgttggacactgtgatggtgtcaccttggctatgccctggtacccagatatttgccaaacatcagtctaggtattgctgtgaaggtgtattttagatgagattaacgtttaaatcagtaggctttcagtaaagccaattaccatccataatatgggtgggcctcattcagtggaaaaccttaagaggaaaagactgaggtcctcaaggaagagggagttcttctgactccagttgcagcatccgttcttccctgagtctccaacctgctctgcagatttcagatttgccagccctcacaaacacataagccagttccttaaaataaatgtatgtatagctcacatttatttcaatgtttcatattagaagtgtttcattctttatttagaagtatagtagtgattttgtgaccagaaatatgctgtagaaactgaactcttatttatctcaattagcctatggtaaaattggtcatgctgtatatcattttgcttaaagctgcagtttccaagaacctatatgacacttttaagtgatgacttgctgtactgcatttaatagaagcacataggagaagcacctgaccctgactcgtagaaccaaagaaggcttttgggagggaatgaagtcgaatttgagaactgcacttggcaagtggaataggagttagccaagtgcaaggaagggtggtggggaccaggaattggactgagtagagaacatgcactctcaacaagggcatgatctcccccaggagaagaaaatgggtgcttggcagacaagataaatcttagctatcacactgttttgtcaccatccaaagctcaatcctatgtgacaaaattgtattcctcttaatatttaattgaggggagggaagatgactaggaaagaatttctaagaaggtctccttaggtgggcaataataaaaaaaaacattgagaaacattggtatagaaagagcatttgggcataggaaagatcacacatgaaactactgaaatgagagagaacatagactatttgaaaaattagaatgggtgtggcatagaattgggagggaagaggaagcaggaagaacaatgagagaagaggccagtctagaaacaaattttaaagaaaattaaacctgaaagtgcatttcaacctcaattatctaaataatttaaagttggattttgtgtctaaattatctacagcacatcaaactcacttttttatgtataaatcatcctttgtgtttgtggtctctactgaatgaattaagctttaaacattgtgttagagatagacaagagcatttgttaagatagatatttcaacctatcatgctagaacttggtagttgtacaactgttgtctctagaatggcatcatgttcaggtgggtaattataatgctattccagcaagctttttaacctctggagaattttcatgtgatttacttcactggagtttcaaagacaaaatatgacactaaaaaaggtatttttcttggtcccattatttagaatagaatgagaacaatggtctatttaataaccattatcgttatcttcccagattgaattaaaattacattaatattccattagaaaattctctgcaaaaatgctgtcaatcatttttttatttctaccagcttgttaacaatgaactcaaagctaattcaatacttttgggagatagtataaaactcaattttagaatctaaagaactaaaaaattgtatgctatgtgataattttaattcctatttttctactacagccttagcttgcttggtattagtaggcttatcctaaatttataatatacttttaagaggcagcattctagtaatatttttagaaggtcttattatataaaacacagtataaaattatataatagttctgagtatggattctggagtcagactgtctgggttcagatcctgagttgaacctgtttgggtttaaatgttactagctttcataaacttgagcagatgtgaaaagttgtgtgatcttaacctctccgtacctctgtacctcatagttctaactatgtaatagaactactacatatttttgtaaacatacagtaataatgagttcattatgtaaagcacttagaacagtacctaggacatactcagtactcaataatgttagcaataattatggaaccccttactgagtagctttaaaaccatttgttgagtctttcctgtatgtcatacaaggaacttacttgtgaaactcttagtacatcttacctaaaatgatgttcagagcatggcttaagatattttttgaaactaactttttaaatattattattgttctctttactacattacaagccttaaaacagattagctttctagggtaggatgatactttttgtccttaggtgagaagatgaacatctaaatttcatttgaaaaagcattccttccagccaagcatggtagctcacacctgtaatcccaaactttgagaggccaaggtaggaggatcccttgaggccaggagtttgagaccaacctgggcaacaccacaagaccctgtctctataaaatatacaaacaaacaacaacaaaaaaaatagtttggcacagtaggatatgcctatagtcccacctgctcaggagactgaggcaggaggatcacttgagcctggatagttgaagctgcagtgagccatgatcacaccactgcattccagcctgggcaaccacgtctgagaaaaaaaaaaaaggcattccttcagtagtaggtgggagatgaattcctcttcagaattttgtgttggagtctaagatttatctttatggaactactatttacatggtaacagtagggaaaaggaagaagagtgacccatgatttactggcttttaaaattttgactaaggcaattccttttcaatatttatatatttcagaaaatgtcactgaaattcacaaatgcaaaacggattgaaggacttgatagtaatgtgtggtgagtatcttaaaataaataataatttagtgagggtttcctacatattttcgtatctttagatgggagttttttttgcctcatccatggtctataaataaaggtcctcatttaattcatccattaaatgaaaatggaaggaagttagcaatccatatactgaattgttcatttggcacatgtgccatgccctttgctggacactggacatatggcagagaaaaggacaaatgttaatgccctcatggaacttaacctccaatccaggaacttttcttattagttctgttctctaatagttgatgaaagaacttagcagcagctggaattgttgagaaaatatatatatgtggttaaaatatgggtagcgtgaaactgaggtttgtaagggacattgggttcataaattcagccatcattctatttggtaaactgatttgtggttggtaaatttttgttggaaactcattttttaaaacctataggactaaactagggtcttatttgtctgttttgtggtaagactataagatataaaaaagcgaactttataattgtagaacttattaatattagtatttttttcaatcttaggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttgtaagtatatcaagaccatatgggccatgagcttttattttatactggggtgtgtgtctgtgtgtgtgcatgtgcccttctgtcattcatatataagtgactttctgggaccagctgtcccatcctagcaaccacagaaacttctgcccttgccctatgtcctgagatgagccttcgcctacttccagcccctctacacttttctttcttttggcccttactttactgttgctccaagataggatcctatggcaacacgataaggaacaacattctcttgagacatgtcttttctatctcatcaacatttatgcagcctgagcactgaccctttatttaatatatccaactagctacgtttttcctccttgtgccagctcactcccatccttctgtaatgaaatgcctaggatagccaaagattttctagatcagacgtacctttgaactgtagacttgtatctgttgtgccaaaagccatacaattatcatatgtctgaccacttgtcttttccttttatgatattgtgggaaatggggaggggaatggtataggaggaagcctgttttttgtcttctatagtggtctaactataaaaatccatagaagggttttgctttgggaatagcacagggaaaagcagtgaaacttacctgtgtcacagggtttgacactggtgagaatccctgctcttcatagatctcactccctggcccaccctacagacccccatctcagacctactcaacataactcactccccagcctatacaaatccataatgaaaggctagaaacaaaccaacaatagagaaaattaatgaaaccaaaagctggttctttgaaaagatcaataagtaaaagttttagctagattgaccaataaaaaagaaaaaactcaaagtaccatatgaagaatgaaagaaggaatatcattactgatcatacaaacatgaaagcaataataggataatattatggataattttatgtcagtacattgacaacttggatgaaatgaacagattatttaaaagatacaaattaccaaaactgacacaaggagagatgaaaaatgcaactagccctatgtcaatgaaagaaaatgaatttgtaattaaagtcttcctgcaaacaaacctcaatacctagatggcttattagtgaattctatcaagtatttaaggaagaactattaggtcagtgcaaaagtaattgcggttttgccattaattttaatgacaaaaaccgcaattacttttgcacaaacctaataataccagttctgcacacatttattcagaaagtggagcaggatgaaaaacttttacttattgatcaacaatttttgtaatttgaaaaataaagaaatgcctaatggttttgtctgaacttttaatcaggggttttgtatcagggtaatgctggtctcataaaattagtttcagcattaccctgatacaaaaactgatttaaaaaatgccagcgaaagaaataaagaaaactccagttcaatatctctcatgaacatagaaacaaagattatgaaattttagcaaatcaaatccagatatgtgtgtgtgcatgtgtgtgtgcctgtgtgtataaagatataaaaagtaatacatcctgaccaagtaaggtttaccataggaatgcaggattagttttaatatccaaaaattaatcattgcaattatgctatattatcagaaaaaaaagatcatcttatgtagtatatatagaaaatgcatctgacaaaattcaaccctcatttataataaaagttttcagccaattagaaatagaatggagctttctcactctgataaaaggaatctatgagaaacctacagattacacctgtagtgcacataatatagtaagattgaaaagacagcaaagatgtccactctgaccattgttattcatcagtgtactggagtcctgtgagatataaagatacatagattagaaagaagaaaaatgtaaactcattttcagaaaacatgattgtgtacatagaatatcctaaggaattctaaaagaaaaaaaagcctactacaactaataaatgaattgagcaaggtcacaggacacaaagccaatatacaaaaatcagttgtatttctatatattaaaatgaacaattagaaagtaaaattttttaaatactatttatagtagtatcccaaaacacaaaacatttaagaataaattttttaaaatatatccaagatctgtacgatgaaatctataaaacattactgagagaaattaagcaatacctaaataaattgggaatgatgttcatggattgagagactaaatattgtctatgtcagttttcccaaattggtctatagcagggttttgcaatctatggcctatggacccaatatgtcaaattttgtaaataaagtttcattagaacacaaccatacccacttatttattaatatgtatattctagtttttgtaaatacataggtatatacatgtctatgtgtttttatattggtataagcactgagagtggtgttgcactatcaccaggctgtggacattcatcacctcagggggatgggaatgaaataatattgaggagcgattgtaatttttatacatctttgcctagttttacttattgcatgaagcataaattatttttgtatttaaatttttaattttaaaagcacaaacacttatcattctaagaaatgtatatagtgtttatagttgcttttcagatctcctcttgctagaatttgttagacctgctattaaagtaaaattcaaaggaactcagtttattgctccagagcccaaagtgctttcaaacaaaggtacatgacctgcacttgcactcttactctcaagggatagaaaatcaggatggtacttcaaaagcaaaatgaggaggtagatgctggacagaaaacaacaggaaatattgacctaaataccaaataaaacaaggagggggaaaggaaaaggaagaaaaaaaaggaaggaaggggagagagcctagaagagaacttagggagagctaatccaggagtcttcagaccccctgcttgcctcaggctgtaccttcataatcccttcacttctcctatgaaagtagttaccttggataaccactgctctcttgactgtcagtgtgagtagtgtctcacttccttctaacatttgctatcacatcaacactagtgttcgtgtcgttggtgaatttgtttttgttctctttccctagtccattggttggcataaccatctctccagcaatcaggaagagccaaggagtgggtatacagttaaagtgggtttttttcacttattttaactgggaaacaaatccaactcttttcaatatgatttaattactgtcaaaaaatacaaatggttgatttttattcaaagcaaatactttgaaattatataatcccaaaccctttatttagtaagaagttttaatcattagcaagccttcatgacaaatagtgtgggaatactctaaatgtaggaaattttaaaaaatttattgccattaaaaaatataaattttcttggggtaattataaacatcaaatccaaattttaaaaattcttacattttagagccatattacctcaaacagtaggtcccatatttaaattcaaggttttgttcttatttttaatccaacagggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtaagtatattaacattatcgtaatacccatattaatcaattatcatttgtcccacctttgaatctttcgcttatattctactcttttctctttttatttttaattatgttttaagtataatgcatgtacagtaaagttcacaaatcttaaatgtacagctggataaattactgtgtaaatttctgtgcaactacaaccagacaaagatatgatacatttccagtacccagaaaacttctttgttcctcttcagagtctatattctcccagaggtaagtactcttctgtcttctattaccataggcttgttttcactgctcttttacttaatatgaatataattatacagtgtatactcttgggtctagatccattcatttatttttgtgtctgtgagattcatccattttgttgcatataatttattcttatttttatagcctatttaaataagggcagatggaagggactaacactgccagggaaaaagaatcttttgttttcattgctaaaataacctttactcttaacttggtctacaagtttttgatcaatgtctttgtgtgcccagtaattgtataagccatcccatgtgaggatgtttttgtgattgtttttgtttttttgagatggagtcccactttgttgcccaggctggagtgcagtggcacgatcttggtcactgcaacctccacctcacgggttcaagtgattctcgtgcctcagcctactgagtagctgagattacaggcgcccgccacgaagcccagctaatttttgtatttttagtagagatgggattttgccatgttggccagtctggtctcgaactcctgacctcaggtgatccgcctgcctcagcctcccaaagtgctgggattacaggcgtgagccaccacgcccagctgagaatgtattaatataataggaaggtaaaatgatttctgcgatttagtactgtgaggtatgaccaacttttgcaactacctcagtcatctctacccgtatttcccattagcattccaatagccttactttaatactttttgcctctttcatttattcagaaaatactgaggatccaatatatgctaagcactgtgagatagaagatgttttaaagatagattctatgcagaaggtgttccctgtctagtagagaacacagacttgcaaatggattacgaggaacactatggtagtgacaaaaggaagaggcaatcacctctgctaagtctggaaagctccagagagacattgcttaagctgggactgcagaacgaatatttatcctgatctatattgttaactttctttaaactctcataaccctttatcataccacttttatgaaagatgccactatctgctttgtgttatgttattcttttacaactttgattcccttcactatgccagacaagatgtttaaggaaacatgttaatgaagttcacagtttcatatacataaactcctttaatcctatacatagttttgtctcatacttcgatgttgttaatcctttgttgcttctttctctgcactctgttgggagtattataaggcttagcccttagctttctttcctctattctttcttccttcatcaacttatctagtattttgaaaccacatacatgtcacttgctatcatactgacctatttattgtttctttatagcatttattactatctgaaattatctaatgtccttatttgtctctccgttcattataagcctctctcagtaggatataagttctaggagaactttatagctttactgccagcacctaaaatagtgaggacgcaataaatattctcaaaaaaaaaaaaagagagagaggaattgttcacatcataaaagtgaaaaaatcaaggcgaagagtaacaggtatatttctcccactctactgccctgcctctccaatttattttcctttattgtgctctcaccttgtattaagctttatatttcccactagagttacaaagatagattgtcttagtccctgagaacttcacagatgaggctgagtgtggtggctcaggcctgtaatcccagcactttgggaggctgaggcagatcacctgaggttaggagtttgagaccagcctgggcaacacggcgaaaccccatctctactaaaaatacaaaaattaaccgtgcttttgagaagagagaaacatctttactctcaagataatgcttttaaattagcactttataccagggaacattacagtgttctcttcccacatagcctgctgtctgtcactgcttatacatcacttatattctagattttattttctgatttgaaatatgaagaaatgcttaatcgttttgcctggaatatccctttgagaatgtgatagtcccattctccaggtaaatctatctatgcatatatgaaattttatatgtaatttcaaatactcccactgcatgcttatttatagatctccctaagataccaaggagtccaattaagactacctggacaagtttgtctccgaggtctcttcccctcagatgttagctccacaagggcaaagcctgcctttttcactgctgtatcccaacacatagtacagtgcctagcccatagtaggtacacagtattattaacatgaataaatgattgacaggttgtgatcttatttgcttttattgcaggtcatactaatagtgcctttctatgactgctatgagcccatggtgagaatggctggagcaacacctgtttttattcccctgagatctgtaagtttgccagtatggttcatatggcaaagtttcaagacttaagaagtcttgaaaataccaattactttgtcatgataaagtttctactttgattgcatttggagatttcctgtatatctctatttgtctagttgtctttttaaaatatttttaacataagtaatacactaaggtgagtcacaaaatcttcagctagccttacaatatcagacatgttaaccatagttatagctagttcctgtgaagtaatattagcagcagttaatgttgacagggcttatttttccatttaacaggtgtgagcataagacttaggttttcttaggctcttaagcagaactacagcccagttatttctgtttatcttctttgttagtctttttctagttttttttctgttcctactgcaggaaagcatttgttggtaatttattcagtttcctttgccatgactttctttgatgtttttttccttattaggttattcgtttgtaagacagtaaacatgacttaattgaattaaattatatcttcattcttcatgcttagaaacctgtttatggaaaaagatggtctagttctgactggacattagatcctcaagaactggaaagtaaatttaattccaaaaccaaagctattatactaaatactccacataacccacttggcaaggtaagcaagtctcatctccttatacagtcttctgacctatcattttctcacatgttgaataattggctgtgctctttcctttattatgtgtaggtgtataacagagaggaactgcaagtaattgctgacctttgcatcaaatatgacacactctgcatcagcgatgaggtttatgaatggcttgtatattctggaaataagcacttaaaaataggtaccaactataacacagagtcacatatctaaatgtgtttgggcacatatggaagaactgattggaaagcatcccagaccaactctaaaacagtctttgtaatgggtatctgtctgtatgaacactttaaaatagtatttaaatgagcaatactttagtgaattgatgaatagttcaaaggacaaagagtaagagattttggatcatactataaagctatgataccagaaaagtagttcttttgcccatatatccctggcttcttagcagaaatccagcaattacttggtacataagacacagggagctttcttgtgcctgaaaaggttctagacggtctatgctgaacaacttaccaaaatgccaagtcaacagaaagaaattacaggggtagtcaggtatgctgcttggcccttgcttgagattcagccattactactgggctatctcatgaatgccgtactgtctgctggggtagtccaaaccatgtcaactataggattacaaactgggctgcaacttttgggtcttcgcacctccctttcctttgcctggaaacacttttcctccaggtatccacctgacttcaaatatccttcacctccttcaggcctttgtccaatgtcagttttcatgaccatcacattgaaaatagttaacacctctccctccagcatttgctttgtcctttttctgttttgttttgttttttcctctatagtaaatatcagaatctatatattttacttctaaaccacagtaatggagggattttgtttgttttagtctcttctgcatccccattttccatagaatcttgtacatggtagagaattagaaagaaattgttgaataaatgaagatgaaagatgaaaagattaagagaaggatgactaaaaaatgtggcagagatagataaattttaaaatttaggccaggtacagtggctcatgcctgtaatcccagcactttgagaggctaaagtgggtggattgctagagtccaggagttcaaaactggcctgggcaacatggagaaaccccgtctctacacagaaattcaaaaaatcaaccaggtatggtggtctgtgcctgtagtcgcagctacttggaggctgaggtgggaggatcccttgagcccaggcaccactggctcactgcagcctccatctcctgggctcaagcaatcctcccacctcagcctcccaagtagatgggactgcaggcacagaccaccatacccggctaattttttttaagaaaaataaaaataagaaatgtaatgcacttatatattaaattgttgcattgttgcatgtgccataattattcctatagtatattacaagttgctatagagatgggaagagaaagcgactgtttgaggggaataaaaaaggagtggccaaaagatagagaattagctaaacagagaaatagaaactaaactcctaaaacataaactagcatgtacttagataaggaggtatgaaagatcaagatacacttaagaaaggtaaatgattattgaaattttaaaaacaaagaagaagaaaggtaaataagttatttaatttttttttttttttttttttgagacagagtcttgctctgttgcccaggatggagtgcagtggtgcgatctcagctcattgcaacctctgcctcctggattccaacaattctcctgcctcaggctcccaagtagctgggattacaggtgcatgccaccatgcctggctaatttacttttagtagagatggggtttcaccgtgttggccaagctggtctcaaactcctgacctcgtgatccacccacctcggcctcccaaagtgctgggattacaggtgtgagccaccgtgcccagccttaatttttttttttttttaagagacagggtctcgctgtgtcacccaggctggagtgcagtggctcagagctcactgtaatctcaaacttttgctttcaagcaatccttccacctcagccccccaaatagctatgactacaagtctgcaccccctcatctggctaattttttaaaaatttttgtagagatagcatctcactatgttgctcggactgttctcaatctcctagactcaagcgatcctcctgccctggcctcccaaagggctgtgattacaggcataagccatagaacctcgcctcagtttgatttatgagggtgtgttttagtaactggcatagatcagggtggaaaactagggtgattctaaaggactttgaatatgagatagagtataaactttgttgaggaggtcagtggttctgaaacttactttagtggtagatcaccatgagatcacagtgttctacatcatgaaatggtgatattgtgaattccatcctgaaagtaatagcaattttcctaaaagaaatccaacaattagaagccaatataaaaatcacacttctgttcatacttgtccacaacaaaaagctattgaaataaacacatttgagtttttctgattttgccattaatatgcatttactaaatgctcatctgtttcactattggagcatccactatcagataagtggtagtatttgctaaaggcttaagaaaattgtgtggtagaaaacttaacattgattttttaaaattctgcacattaatttgatcaccagagtgccagtgagcttactttgagaactattgcaaaaggtgtaacaaaacaggagaaatggttccatgactagatttttttttttttttttttacaaagatgagagccagccacagaggagggtcttaagcaaatcagataacctagcagtgaagatggtacatcggggctatttagaaactatagagtatagcatttgaaggtgggaagaaaacaagcatgctactaagatctctagcctgaactactcagcagtgatgagacctttaaccagggtaaatatggagaggagcagatttgtatggaagggctgagcaaagggaattcctgcttctcatgctttaaacttgctgagtttgggtgtctgtgggacatagaagaatagatatctggggacaagtggaattataggcctgatcgtcagaatcaaattataatgggatatatttttggcagtcatcaaaatgttggtggtagctggacacatggaagagaatgaattttctcaaggggaatatataaacagagaaggcagccagagatttgcagggtgtgacaccttaatacaccaaaatgttatcatgttttaaattgtatcagaggccacaattgcccatcttgttggtgacctctgtctcaagtaatttgaactgtttcccagtggaaaatcagattaacatgaacaattactttcttgttgtaattaactcagtgtagcaatattcatcccaaaaaatcactttagatcatcttgaaatttattgtttagatctactcattttaagcccttcagggtaaagcataactggtaacattatttactaaagatatgcaacagtatttactaaagatatgcaagatgtatattttgaacttagatttttttatttgtagcagcccataaagtttaaataagaccaaaaaatggatacactatttcattatttagaaagtgcaatttgtttgcattaaaacttaggtattctatcgaatacaatagtctttgttacattaaagatgcaaaatggctacaaaatggccattacatcaatttgcaaagtgcaacagtagtcctttaatatatgatgtatcctttactttaaaggaagtgataatctgcattatacgtagtttagattttctctgatcaaatagaaaagtggggcatgtgtcatagtgttcttttggagtattttggaagaccagaaatgtctcagaagggatataattatttatatcaaatcttaaagtattccttcttcaagtggacattctaactatttttctcatttatctttttgggttttgtcatattccacagagaataaaattataacttttctgatttatatgcttttcctactgtttcaaatttagcaggtatttcagggtagactgaaattacttatacgttgttttggaaatttctgtagctgccttacattttagtaggcactttacttgcttatgagcagattacttcaagaaagcagaagcttagattcccagagatgagcatttattttccctttgtgtgtaccaacactctaaggacaatacaagagcccccacttgtgcttctgaaaaacaagtggaaaaacttgtgggttgcatggaaagaacttcacaagtaaattacttgaggaatccacaaagcagtattgtgggtggcattgtcagaagagtgacagaatggtaatttaccagttattaccaatgtctagcaaaatttacaaactcttgcattttagacctctagacctttgttacctgcattttcttagcccaaaatatcttcattccccttctctgcctggctacagcctatgtggtcttctatgtctcagcttaagaattactggctgcagaaagccaccctcaacaccctcttctattcttgcatcaccctccatgcctcctactacagcatttatcacactgcattacagttgtcattgtatgtggctcatgtccctactagacattaaattttttgaagaattgcatcttattcatttttggttcctctagaccttagtccttagcacctggtggttgctaatgaatatttgatgtatgaatgaatcaatgtctttattaaagatgttaaacaacttgaaaaccattatacagccaattcacattattcttgagttctgtatttgcaaatttgcctacttcctaaaatatatgtgtaattccaaaatcaataaaggggaaatttgagtcaccctacacacattcccagtcgaggtcaaacaaggcaacattatgcttctgtttcaattcacactataagcaattgttctctgtacagtgattttgctgtttaaaatggcccccaagcctagtgctgaagtgctgtctagtattcctaagtgcaagaaggctgtgatgttccttacggagaaaatatgtgtgtttgataagtttcattcaggcacaatggccatgaggatattaaagagtgatagctaaaaggtacagggcttcttttgagataaaaaaagtgttctgaaattggttatggtgatagttgcacagatctatagatatactaaaaaaatcactgaatggcatactttaaattggtgaatttatgggatttatatcccaataaagttgttagcaaaacacacgcccatacacacatacacacacacatgcacacacacacacacatgtgcacacatgattactgggtcccactcccagagtttctgattcagtaggtctgggatgaggcccagtgatttgcctttcttacaagttgcccagtgatgctgatattgctagtgtgagatcacattttaagagccattgctctaggaagcctggagaaatacactcagaaaataggcaaaataaaggggcctaaacaataatcaggatcacaacctaagccctgccactggcctattttatcgaacctgcagtcactgctaacattgaacactgaatgctacagctcctgtgacagctgccacttaaggcagtctggaacactgcctgctggtgcccctgacactcctgccccagaactaattttaaaattattaaatctatttatatactatcttggtgcaacattacagtattgtaaacttttcgtctgtgttttgcattaaagttacattatctaaaaaaaaaactagaaataactatactggctaaattataacacacttattttcattgaatttatgtatctttgttatgtttttagattatactaaatgtgattaattggaaaacaatatttacccttttttcctcctctgtttagctacttttccaggtatgtgggagagaacaataacaataggaagtgctggaaagactttcagtgtaactggctggaaggtaagatgagtaagaatttaattgcttaaaaataggcctgtatattatttattttttgttgagtggtttgtgttttaaatgctggccaggcatggtggctcatgcctgtaatcccagcactttgggaggctaaggcaggaggatcacttaaggccaggagttcaagaccaaccttggctacatggtgagaccctgtctctacaaatacattttttaaaaattagccaggcagggtggtgcatgcctgcagtcccagcaacttgggaggctgaaatgggaggatcacttgcgctcaggaagttgaggctgctgtgagctgcgctccagccacttggagacagaacaagaccatctttaaaaaaataatgaaataaataagtaaacaaataaatgaatcattgcatacatattcagtttatatagatttttatacctggtgatctttgcttatctcttgacttatttggctttcatgttgagttttatcctttttgagacctaattatttctttaaacataagaaaaattaggtcattttcccttttataagtgatcaactaatgacacctttttctttgcaaaaaagtgttcagattgctgcatattaatataaaaggagaaaaataatagtagctaatattttggcaggttctaaatatataccaggttctaaatgttttacatatactaatttctttcattctcataaccacactataaggtgggtatgattagtgtcctcattttacagatgacagagctaaagcacagagaagttaaatgacttgcctgagattacccagctaataaattcaagcctgtacaggaagtctggctccagaattcatgcacttaaccactgtattatttattacaataatttatccagttaaaacccaattctcttccagcctcacctctcctgagcatgggtaagaagcagggagcatcggccaggcgtggtagcgcacgcctgtaatcccagcactttgggaggccgaggcgggtagatcacctcaggtcaggagttctcaaccagcctaacatggtggaaccccatctctactaaatacaaaaaaattagctgggcgtggtggcgcatgcctgtaatcccagctacttgggaggctgagacaggagaatcacctgtacctgggaggcggaggttgagtgagccgagatccggccattgcactctagtctgggcaacaagagcaaaactccgtctcaaaaaaaaaaaaaagaagaagaagaagaaggagggagcatcaaaacaaaaattaggcctggagaatcaagtctgtatgttttaattacaagtcccttaggccctctttcagagttactttaatctgtaattcaaacaagctttgttaccagtttttaatcttccagaatatcagaagtagcaaattattagaaaggaaaaggctaataatgatcgccggctgtttaccttcagaaaggcagagcttagtgatgaaagcagagtttaatgactccatttggaagctgttccttgaaaagaacaccattgaaatgattctaagtactaatactgtactactttcatagtgtgaactttttttttttttttttttttgagatagagtctcactctgttgcccaggttggagtgcagtgctgtgatctcagctcactgcaacctctgcctcctgggttgaggtgattctcctgcctcagcttcccaagtagctgggattacaggtgcccaccaccatgcccagctaatttttttgtatttttatagagacagcatttcaccatgttgaccaggctggtcttcaactccaaacctcaagtgatccacccacctcggcttcccaaagtgctgggattacaggtgtgagtcaccatacccagccaacattttaggattgtatatatttaacaattgcactaagtttaaactgctgtctcagatttgttatatacaattagattttctgaaatcttttatcttttcctttcccagcttggctggtccattggtccaaatcatttgataaaacatttacagacagttcaacaaaacacgatttatacttgtgcaactcctttacaggtaagtgttatagtaactcagggtagaagcattgtcttttggtgaaggtattacttttatattgcatatttgaattgacttaattctccttctatccttctgttgcagggccttctaatataatttggaatttggggagcagatacatattcactgttatcaagcatggtttgggtttttttttaaacacaattttagctgtgttaaacattgctggcaggaatctaaagtgctacaaattctgtgaaggacaatggcaacaccaaacaaaattacacatgtgtttgccccatgaaagcaatccatcttctaagaatttaccctaaagttgtgttttagtccgttcttgcacttaggtaaagaaatacctgagacttagtaatttataaagaaaagaggtttacttggctcatggttctacaggctgtacagaaagcatagtggcttctgcttctggagaggccttagaaaacttacaataatggtggaaggcaaagagggagtaggcatgtctcacagggctggagcaggagggagagaagtggggaggtgcaacacacttttaaacaaccgtatctcacaataactcactctcatgagaacagcatcaaggggatggtgctaaaccattcatgagaaaccactcccatgatccaatcacctcccaccaggccccacctccaacattgaggattacaactggacactagatttggatgaagacacagatccaaaccatatcaagctatctgcacatgtaagaagttacgtacttacctggctattcattgcagatgattgaggagaatccattatcatctacagacgattgattacataaaccatgatctatccaaacattgaaatgttatatgaccatattaagtttcctactggtgctataacaaattaccacaaacttagtgacttaaaacaacacaaatttattatcctacggttcttcagctcagaagtcagaaatgggtcttaaagggctaaaatcaaggtgctggcattgctgtgttccttctgaaggctctaggagagtctgtcctctgcttccgtcaacacatttcctgtggcttcaaccctcctgcctccctttttcccttataagcacctttgagataacattgggcccaatggataatctgtccaattaattaaggataatctccttaatttcaatcacatctgcaaagttcctttcaccatgcaaggtaacatatttacaagttctgggttttaagacctagaagtcattgggacccattactctgtctactggctgctaaagagaaaagaaacaagaaagaaaatagggaaatactataattactgtactgagataaaaaagatttctagaatacatcataaagtaaaaaagaaaaactatttaaatattatttaatatttaatatttttaatatatattatggaaatagggatttagttaccatcattctatggataatcaaaatgctgaaaaaaatagtatttttctagaaggcagttaaaagggcaaaagaaccaggcacaatggctcacgcctataatcccaacactttgggaggccaaggtgagcggatcacctgaggccaggagttcgagaccagcctggccaacatggcaaaaccctgtctctactaaaagtacaaaaattagctgggcatggtggcaggcgcctgtaatcccagctactcaggaggctgaggcaggagaattgcctgaatccaggagacagaggttgcagtgagctgagatcgtgtcactacactccagcctgggcaacaacagcaagacttcgtctcaaaaaaaaaaaagaaaagaaagaaaaaaaagatgttgatagatatgaagaagaaagataaaatagggaagaggaaggatataaagctccaggtgggagatatacagtgttaaatagggtaatctttgaaagcctccctgataaggtaacatttgaacaactaactgaaggggattaagcagccacatggttacctagagaaaaacccctttggacagagagaacaagcggaaaggcccagtggtagacagcctggctggcatgttaatatcagagaacagcacagagactggaatggaatgattgagagaagagtaggaaaagctaagatcagagaggtagctgggagtccaatggagctggggcatgcatgtcactgtaaggactgagtgagataggaagtcactagagagttttgaactcaggagtgacttggtctggcttgtgttagcaaatggactctgactgcctcattgagtgagaaagctgttacagtgatccaagagagaaatgccagtgcattgaacaaagatgggggtggtagaagcagtaaaaagtgattggactctgaatatattttgaaagtagagccaacattatttgtcaataggttacatatgggatatgtgaaaaagaaaggagtccaggataatgctgtagttaggatggatgtttatgtctccttatacttggaattttctaaggcagtatctcctatagtaaatgaacaagttgccaagagaaaaaaaaaaaaagatatagctaagaatgcagaacatctttttctgaacactcttattctccatttcagctaggtgctctgttttgtcctgggacaaccatgtttggttccaggaaaccacagatttccaggctaaggcaatcgatccttattttccaagattttgtagtactggagatttattactaattctgttttactgcattcttttggcataaaatctctgtgatcttgcccctctctgtctccagtctcatctcttgccacacagtctctcttacctgcctggtccttaatgtcttagttggactgggtggcttataaacaacagaaatttatttctcactgttctggaggcagcaaagtccaagataaggcaccagcagatttggtgtctggtggggacatgcttcttcacggatggtgccttttgctgtgtccttacatggtggaaggagcaagctaaccctcctttgtaagggcactaatcctgttcctgagggctctacccttctgtcctaatcacttcctaaaggccccacctcctaataccatcaccttggggtttactattttaatatatgaatatgagagtgggcacaaacattcagtccactatacttaacaacattggctttttccttggcccagtttgctgtcctggctcttgaagaaagatagaggaattactgtagatgttccagaaactcatttctagtccctcttacactttgaccaacttcctggcatatgaataattccagcaaggatttccacacctatggagaataagaaaggcacatttctcctttgcacagtaggtgagctttcatttccactctgtccccaaatgtaatggtgagaggctgactactctctggttgttcttctgacttagatttagcaagtcattctacaactcacctcagcagaaaatatcttaatgtctttttgtttccaagcaagccacctttaagtaacagctctttttcaatttgaattttcaggactccttctcagttcttcacatgagatttaatcatttaggtataactgattcctccattaacctatagagtttaatataggttcacaggaattcaactgttatttcctgagtgacttctttgccaataattttactcagatcatctctatttattataccaataaactaagcaataaataacattgccatatgccttttcatattttttgattcttaacaaacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctaggtttgtaaaggcttttattatttcaactatacggaaacttatgtgtgaaattatatcagaattatggagaaaagattggtgtcaaagccacagcagcattttatctgtggagaaggatggatttttgcaatgtctacattttctataattatctttacttttaggccttttaccttaaatgtgaccattgttaaatggttatggagtcagtgttgttctagttagtctattaaacataggatttgctatcactctcttctggtgtgtaattttaaaacacaagtgtgtgaaataatattatatactcagtgttcatttgagtaaaattgtagtttcctttttacttaacaaaatgtactatttcattagaaaaatatctagaaattttgaagctatcagggaatatttgccattttagaatgtactgaaataaaataaatgggagaataacacttattgagggtctactttgtgccacgtactcaaaacacccttttgaagaaaacattagctccatttttgcaggtaaaaagatttagaaagttttaaatagcttccctgaagtcacacagctagattctaaatagttctgtttccaaaaagcattgttttttatattacctaaagctgttatatgtaattctgacatgccatacaaatctaaagttagaagcatgataatgtgtcatatataacttttcttttaaaaaaattagtaatagtaaaccttgaagcctaatttatcatgacagaaattacagccattctaaatatagttttaaatgttttaaaattttattacaatgaagttatatgccaatgaacttgaaaaactgaagtgttttatttatactaaattgtataaagctggaaagagtaaaggaaattttcaattttatagcaaaacattgatcatattttttaactttacatccttcacataggagtttgttttgttttgttttgttttgttttgttttgttttgttttgttttgtttgaggcagggtctggccctgtcacccaggctggagtgcagtggcgtgatctcagctcactgcaacctctgcctcctgggctcaagccatcctgccacctgagtctcctgagtagctgggaccacaggcatgcaccaccacacctagctaatttttaaattttttttagagacgaggttttgccacatttcccaggctggtcatgaattcctgagcttaatgagtgatccacctgcctcagcctcccaaagtgctgggattacaggcatgagccactggctgagttctttcttactataagcatttgatgctagcaatttttacttgtaatagttcattatcatcttagcaaatttcagaaaagtaaggtgttatgattttcctataatttggtcttcaggtctgtctctctggaaagtggctgtaaactctagctgttccctgatggggctccaggggaggtcctggatgtttgcagtgtgcctttcatgggctacttgtttatcctggcagatggcctgatgttaagtgtctgacccatgaccagacatccctggaaactggtttatactggcagacatccttgtggctctcatctgacctgtatccagtttatttccacagagatagccactctctaggaggaggagagttaggttccggtgtgttggtcagttgggacacagaagaggcagcaggcctcccgggaccaatgggaagtgaggagtggtccaggatatacacactcaaccagcaggtggggaacagagagagagtgggatctgtgggccaaagcctttttgggggcccaaggtgttacccaagcaggtttcctgcagagacttctaacagatgggtttagagcgagcaggcacaagctcatggtgtcaggctgtgactgagaggtggtcactgtggcatatctaggcagtccatgaggagggtgggggtcagtgggcgagtcaagtaggttgtatctagctgtaccacagtgaggtgctcgccaggaggtggttgtctcaggcagatatctgaatcaactacattgaggaactgtgaggaggaagagaagtggaaattgtgtcaagggtgactaagccctgcttctggtataagaaagaccaacttatattcacaatggatgccaagacaacatacagtcataagaattcattacatgaggtttggctcaaactgaaacactctccttcctttcacattagcttatttcttcatttgttgtgagagaagaggctttgacaagcaaagattcctgcagtgctattgccatagagctgtatttagcaggctcccaagctctatgcttatatagaacctcttaaggtgttctagactctgagatttgggaagtgctttttctatattgagtctaaatgtgcagttcattttatgaaatgataaaaaaaattagcacagttgtcatcacttatatttttgcctttgaatcataaatccccaagatttccatatgaattattatttttttaaaagaacaacatttgtactttatatgcttccaaaaggaatgtgagccttctcatattaaaagttttctatgcagtaatatataaatagaaatgattgtatctaaatcaaaaatcaatgatacatggccagtacagtgactcctgcctgtaatcccagcactttgggaggccaaggcgggaggattgcttgagcccgggagttcaagaccagcctgggcaacatagtgagatcctgtctcttaaattaaaaaaaaaaaaaatcagttacacataggagggaaagaaagcaaatatttcagtcacctaggttcacatagtattgtaattagcattaacttgagactaaacttcctgacagtaaaggcaaacagaaaaatgaaattagttgcgtagtttttgaataaaaagaaacttagctttttagataagaacaattctttcctggaaccaaacttttccagatatgaaactcgatttatcacattgtgacattaactatcaaaagaacagtgataaaactcagaatattacattaagctcctaattagtttccatttctttcctcagtcaatccattctatatgcaatactaatttaggtcttagatcttgaactagtgtggtgataataggagcaaaaaggattttggttaggaaagcttttctgataatgaaaacaagattttttttatggtcttccttcactcgtggaaaaatgttaatgtccacaaaaccttcctacatataaagaaatttatgttttgttttaccttttcatctgcttcatttgcaatgtgataattcttccatatactaaaagttggcccataaactagagataaaaacaaaaactcttatttaatcgtagcttgagaataaaagtaaaccataatattcatgaaaatagtaatgacttccctttacaattaatagcaagggctgactagttaatatttattgagaatttatgatacagtatgaattacattaggagctttgcaaatatattctcacaaaagctatatgaaattggtgctattatatcactattgatagagaagaggagatagagaatcaagtaatttactgaagttaatcaactaataagtatcaaagctggcctctgaatccagtaattagaagacaagatttcaaatgagattattacagtttttctagtgaaataataggatccaaaattatggaggagatagtaagaatgcaaaaacaaatttgggccttcatagattacttagatatgctcacacatttgatttaaactcttactgtcaataaagaaagactttagttcccttgaggatgtctggctgaggcatgtcaaaagaaatagattccaaattccttctgactaaaaaacctttataattatatttattcccttctttcctttttcaacatcatggtattacgttacttttttctggcagggtaccatggctcaggcctgtaatcccagcactttgggaggccgaggcgggtgtatcacttaaggtcaggagtttgagaccagcctgaccaacatggtgaaattccacctctactaaaaatacaaagattagccaggtgtggtggcgcatacctgtaatcctagctactcaggaggctaaggcaggataattgcttgaaccggggaagtggaggttgcagtgagccgagatcgtgccattgtactccagcctgggtaacgagagagaaactccatctcaaaaaataaataaataaataaattccttttgtctaagctctacaagaataaatgagtagtacagtgtcaattagaattagtcaataatcctcttctactcccttaggtattcactcctttctctgcctacctgtgtaccttcaatacactgctgttgtatacctgtcacatggaatttttacataatttacaattagactaagttttttagctggtatttttgttagggccaaacctgaattacatataaataccttgaaataataatttaacttccttatctgtaaacagaggattatcattacctctcagaattgtggtaacaactaaatgagatgatcatgtaacatgcttaaccaataagaagtgttcaataaattgcagtttgttgttggcattattacttggaaattttatgttctccttaaaacacaggggagaatggagattaaaatatcaggtaaaaggatattagggctttgttttaaaaatacaggtgaacctttcttcagtgtcaaaggttttacatgattaatttgaaaagaaccactagtatttaatgtatagaagaaagaagtaagatatctgcctcaatttgttttcagcaataaattataaaatttcctggatgacgataaccatcaatattagttgctttagggcattcaagaagatcaaagagtacaagtcaataaagttgaaacaatatgaaatgtggattgctgaaactgaatgccagagatatatcttgcccagaccttaaagcaaaattgaggcaagagcaaacaggagtatatatttgactttttcacaaatttaaaaaaaggtataatatatgggagcaagagatgaaaaataagagtagcatttggaagatctaaacagatatcctgtatttataaataatgcataatattaatttatccattcaacaaatatactttttgtcacttatgtgctagacactgacctaggggttgggaatacgataggttaccaaacagacactttacttttgtggaacttatagtcgaatgagtggctatgtggagatataatcttactgatgaatacttaaaaatttagcagttatttccttagtaatgatcatagagtcttatttctcaatggaaaggcatccctcctctgcccttcaccttttctactctcttcctgtgctgaaagctgcacgtataagcctaatcaccctgatgtatatgtgagtactgccttagactatcagtaaagctctgtgaattcacttcccaccccaccgtacagtgtgagactccagcatattctgtgactatgttctgagaaaattctaaaccaagctaatttaaataggagaaaatgttgaatcttgatagacttaaatgaaatacatgttgcatcagatgaaattcataggccacctaattttcattgtggttttagatccagacctctctgatatgaagaataatgagccttatgactataagtttgtgaaatggatgactaaacataaggtaatgtttattgttctttgcaagattctgttatattttatagttaatttttgaaggaaatctgctggtatgctttgaaatcgatcaaatgtaatgttgttatatgatactccacttgtggcttttaaaagcatttttctttttggaaattattgtgactatttaaaagtatctagttgcctctagtatctgtagtaccaaaattaatatttgaagtgtaagtagttttcttattatatgtttctatttatttttcagaaactatcagccatccccgtttcagcattctgtaactcagagactaaatcacagtttgagaagtttgtgcgtttttgcttcattaaagtaagttccctgctctattgaaaacacatatatagtatcttcatttcaatttttaaagtactattttcttctgtttctaaaaatgatatgctcatatgcagtttttaaattttggcttacggctttaaaattaactgcttactggctgggcgtggtggctcatgcctgtaatcgcagcactttgggaggccgaggcgggctgatcacgaggtcaggagatcaagatcatcctggataacacagtgaaaccccgtctctactaaaaatacaaaaaattaactgggcatggtggcgggcacttgtagtcccagctactagggaggctgaggcaggagaatggcgtgaacccgcgaggaagagcttgcagtgagccgagatcgcaccactgcactccagcctgggcaacagagcgcgactccgtctcaaaaaaaaaaattaactgcttaccaaaataaaattcaacactttttgaaagaagacaacataatacagaccccttaccatgtaatatgacaatttctagcttacaatgaaaaattactagacataagaaaacacaagaaaatatgacctgtagcaaagaaaaaaagaagttaatagaaataggcctaaaggtgacccagatctagaaattagcagacaaggactttaaagcaaacatttgaagtatgtttaagaaattagatgaaaacgtggtaataataagtgaacagagaggttcaaactattaaaaaaaaaaagaaccaaatggagattcaagaacttaaaagtctaatatctgctatgaaatacttatggtgctaagagagtactgaagatgtcagaaaaaaagggttaacttgaatacagattaatagaaattatccaatctgaaaaaaggagaaatattatttttaaagagtgaacagaacctcaggtctatgagacaataccaagtgataatatatgtgtcattggagaaccaagaaaaaaaagagagagaatatgacagaaaaaatattttaaggaataatagtcaaaatgttcccatatttggtgaaaagcaacttatgtctaaaaaggtcaatgaaatacaacaggataaatattttaaaagcacaattaggtacatcataaactgctgaaaacaaaagtgaagataagatattaaaggcagccagaggtcaggtgtagtggctcatgcctatagtcccaacatgttgggagaccaaggcgggaggattgcttgagtccaggagttcaagaccagcctgggaaacatagtgagatcctgtctttataaaaaaatatttttaattagccaggcttgctggcacatgcctgaggtactcactattcaggagtttatggtacaaggatcacatgagcccagcacgtccaggtagaaatgttaactaacttcttatcagaaacagcggagaccagaatacaatgaaataacatcatctgagcactgacataaaaaaaaaaaaataacagcctagaatgctatatctaggaaaatagcctttaaaaatgaaaatgaagtagatatccctgacaaatgaaagctgagagatttatcactatcaaacttctccttttttaaaaggttccaagtgtgttactgctgttttcaaaatgttgttggtactgaaaatagtcttactgagatcaagacactctatcaactcactcatctttaaacctaatgagaataacataaacactgttttcaactttcagagacaaccgatagccagacttgctcagaatagaatataaatattaacaacctaacaatgtaaacattcaattgactgaaattttaaagaacggtaatgctattaatatccttcatcttacactggattgagaaatagtggtatattatttgaaattgtaaacaaaactaacagaagaaagaagtaacgtaggacttccagttttaaaatggtaaacccagccctcccctaatctctttttagaaattatttaaaaacaactaagagaatagaaaacaaattccccagtgtttaaggaaaggctgctaaatactgtgaaggtgatggtagagggaagatccctagaaaggatcctgcttttacatcttcaaattacagacaaagccagcaggcagcatactcattattgagaacagtaggagcagtcgctgcactggcagcaggaacttctctagaccgtttggcatgatggaggaaacggcaaaaacatacagtcatgtcatctggaaactatgtaaggcaaggtggaaaggagactctggttggtctatagatttcctcatttactcctgtcattttgctaaaagctatgttgaagcaatgcggaagagatgtattaaactggggatagccaatttaattatttggtaagaactgtggtctaaaagaactcccacccactgaaccctacatcaactgtattaaattttactatgagacaaggagaatttctgctcttttctggtgctgccccagcttctcccttatacaaatcagcaaatctatcttcaaatcacagacaaagccagcaggtagcatgcttattactcagaacaataggtatagtgcatgctttggcagtggaaaacaaagaattcaatcaaaaatgattaataatcaaagaggaggggccaggtgcggtggctcacacctgtaatcccattactttgggaggccgaggcaggaggatcacttgaggtcagcagttcacaaccagcctggccaacatggtgaaaccccatctctactaaaaatacaaaaaattgaggtgggtatggtggcacatgcctgtaatctcagttacttgggaggctgaggcatgagaatcacttgaacccaggaggcagaggttgcaatgagctgagattgctccactgcactccagcctgggtgatggagtcagactctgtctcaaaaaatataataacaataataataataataaaagaggaaccaactgtgaatctatataggacagtataaggaaaagagaaaggtacaaggaaaaacaagtgttagagaatattcgcccaaaaaaaatgttgccatggagcaaataaaattagtgctatttcagatttaaaacctttaaaatgagaaagcagagattttacgaattcagggaagatagagtaagatattataagaagatcaaatgggagctatcagagttcaggtaggaaattgaaaagaaaaaataaagctattggaaattatggtgacattattaatagaaacaccacaaagaacactaaatacttctgtaaggacattaaggatggagataagtgagcaaaaggaagtagaaaggaacaaataatttttaaaatattaggcagaaaaattattgatgcagaggaaaaataaaatatgtggagttgccagaaaaaaataagagcagaacaaatggaacctgcatataataataattgtcacacaattattaacactgagatatacctcgcttgatatattgggcttcaaagacaattcctttggtcacctagacagtaagatcaaggcctccagaggggccagaagaggaggatcagtatggacccagactcttcttacatcagcagtcaatattggcagatagtgtggaagtagctggaagtttctagggaaagtggacacacctaactccacctcttagaaagactaaaaatcaaagaatgacaaaaacataccaagaaaatagaaattgaaagaaagcagtttgaattcagagcaaaataaaagtgataaaagtaaataaatttaaggcaaaaatagcactttataatattatgggtaagatccttagtagttgttaaacttataaaagttgtcaaacttatttcatagtaagggaaatgaaaaatagaactgcaaagaaattttatctcttagattggaaacaaccaaaacaactaaaagtttcataaaacactctcacaaattgagagtgggagtataatttgtaaaatctctatggtggttagtttgaaaatttctgttcagatgtgatttcccataccctttgatccaacaattctacctctacaagtgttttcttgtggatttatttgcacatttcgaatgacttatattcaaggattttcactgaggcatcatttgtaatagcaaaatattgtaaacaacaaaattattcaccagtgggggctgcttgaataaatgatgctacattcagatcaacctaaatgcccatcaatgctgtcattggataaagaaaatgtggtacatatacaccatggactactatgcagccataaaaaagaatgaagtcatgtcttttgcaggaacatgggtggagctggagcctattatccttggcaaactaacacaggaacagaaaaccaaatatcacatgttctctcttataagtggagccaaaaataatgagaactcatgaacacaaagaagggaacaacagacactggggcctccttgagggtggagggtgggaggagggagaagagcagaaaagataactgttgggtgctgtgctcttaatacctgggtgatgaaatgatctgtacaacaaacccctgtgacatgagtctacctatgtaacaaatcttcacatgtacccccaaacctaaaataaaagttaaaaataaataaacaagaacaataaaaaatatacaattttaaaaagaaagatggatgaaaatctctggaaaaatatataatgaaatcccagtgttgtctctggagagaaaaactgagtggctgaggaagataggtgggaagctgacttactttaaaacaaatatttttaaatgctctcaacctaaaagtttcaagaacttttttctaaactatttcagagtaagttgtcaacttaattactgaggatgctccgatcacccccatatactttcttgtgtattcttcataaacaagacattctcctcccaaaccacaatataaccctcaaaatcatgaagttaaccttgatactccatctaatcctcagatctgatttaaatgtcattcattgtcccaataatgtcctttttataataattaattaattcaggctagaatcatgcattgcatttagttgtcatgtctccttcaagctagaatggtttctcagttttctttgactttcatgatcttgatacttttgaaaattatcaatgaattatttttaagaaagtacctcaatttaagtttgatgtttcctcatgcttagactcaggctatgcacttcggcaggaaaccacagaagtgatgatactctatccttttcattgtatcaggtggcacatgatttcatttattcctattaccagtgatgttaactttaaccacctgattaaggtggtgtttgccagtcttttctactataaagttatactttttcttgttaaatagtaaatattttgtagtaaggtactatgaaaatattccatatctcattaagcaatttatttattaacttattcatatgtatcaatgtggacttctggatttttattttgtagtacagtgggctataatttattattattattacttattttgatacttagattttcccagatttggccactagtcatgtaactactaatttaatcaatacttctgtatgggatcaatctcctgtcaaagccactgtgcatccctcaccttcccagtccctgagagaatacccttttcccggttcaggctttgacattttgtgccaggctgctacactacatcttcacccgacctgggctttatcacccatgccgacctgtcctgtcatcctcctggagaggtgcccccatctaggtctccaataccccataccaggccaccactgtcacctactacacagaagccctccttgcccctcttgggcactgacaccatgccagatgcctgcctcatctcatccaggctccaggaccctgcatgaggccaccctaccatacaggtgcctcacttaccccactcagactctgacatcctgttccagccagcactatcacctcatgacacccatgctgaccagcctgctcactccactctggctgcagtgtcctgcactagggttgccaaggctctcccagccctatacatggacagccgctttgctcagcctcacctattggctttcagactgaatcattctgatggagagagaagacaaagaaaaagaagtagagaaacagaagatgaacaacagaaggctggattttctctgcttacacctctgtttaattttatgctatatgtatgaatcacctattcaaaaaataaactatttttcaataattacaactatgaaaccttgaaagcaaggggcagagtagtgtgaatgaactaatttttttttgttcagagcaaagtatagatatagtagataatatgtgaagttcacaaataaggaaatagaagcataagcacattattagattttggtggtagccattagaactaaatccagaaattgccataaaaggttatcttgaaggtagagggagtcataggaagggtgaagaaggggtggagcagacagctattatttttcagtgtaaactcttctgtaccctttgacctgtttctgtaattataattcatttggttaactgttttcctgttttgggttctgcttttgctttttcactttgaaaatttttcttcacttgagatcagatattcacttaaatcttcattatgttgtatatttaaatctttgcttcatcttgaatttatgtatatctgtaataatgatgattatttcattaatttacagaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgactttagccggt

SEQ ID NO: 37251 - DNA, 110553 bp, Homo sapiens; identical to SEQ ID NO: 36934

SEQ ID NO: 37252 - DNA, 110553 bp, Homo sapiens; identical to SEQ ID NO: 36934

SEQ ID NO: 37253 - DNA, 4176 bp, Homo sapiens
gcgttgaggctgcggtcatggagggagcaggagctggatccggcttccggaaggtgagggccggagggcaggggctaggcaggcgcggacgctccgtcccgacctcacgcgtgacactgtgagggccagacgccagcccccgcgccgccccctgtgcctttgaggttgggcccgttctcagactccatctccggccgggccgcgcgccccgcgccctcgtgggctggtgtctcgcagctggtaggagggggcgtggagcagccggggctgcgggaaggtggagagggtctgcagaaacaggcaggggtgggcgccgtcacggcggagtccaagccggcgaagagagaggaggagctgggccgccgccctgcgccctgagcctggggtcttttgttaaggggagatgaggccccaggacggggacagtgagatcgtccagcccgaggagccggcaggacctaccccagccgccaggcacagtggtttcccttttgtttgctccccggtgggcgccagcactgggctaggaacgcgtggtttcttcggtgctccacgttacacacacttgacagggattaaccccacctgccagtggagaaactgaggcacgggggcgttaagtgactcagcagggctagggtcagacctaggccgtctgagccaggatccgcccaggctggagggcgtgccctgctcttccctgttcctggaagtggagctctctgggggtgccatgtgcagaggaccccatcggtgcaggcagagtggtttctgaacctttctactgctctacctgaaggttggggcaccgagcttcctcgatgtcagcagggcctcgtgggcctctgtggcctgggaagggagggtctcaggcccttgtgaacccatcctggagggaggacttcagccctgtagaagcagggagaattctgtttctcctgaatcaggcccttctttatcacccaaggcagcaggcgtggggggcggggggtgtcggtgtggggaactctggtggtggagttgaagattcttgccggaattcagaaagagaaagtcactgaggcttgggccacctcactgggtggttgtgagaacaccaggttaaagtagccaaaaggccactgccggagacggggcactgggtacacaccccaggaggtcatgtgttctatcaagcccacctgacaactagaggcccaggggctctggccagagctggagttgtggtcattgcagagaatgagcgtgagaatgacggggagtggggggcccgtagccctggcgtggcgcccacgtcatggggcaaagctggctgtgtcctaggcaccctccacaaccgccccagtgctgggcctgccttccgaggccactgccgatgtacggggaagccccatggattgtcgaggcagacctggcatccgccactctctggcgtggtcttccttccaaggcctggggcagcagtgttgggggtcccggagcaggtggggagatagtgccttctctaccttttctggtgcctttctggtactgctggcagtaagcagctggaaggaccagcaggtggcactgggctcatgcgggtggtgactgggaccctggctagggaacagcaagggctcaggacgagccgggatgctggacaagccgggatgctggaccctgctgcccgctgctggggaacattcttcaccatctgcatcttagggcttcacccgtccatgctctgcttgtcacctgctggactgctctgggtgaggtgctgtgacctccctgtggccgatgctggtggcctggctggtagttcacccacctgcccttttagtggcctgtttctgggctcctgggtgcccactgcccccacccccagtcctggactctccgtgctggctcctttcccggcggctgtgggccggtgcctggcctgggccacctcactgagtctcatggctccaccagccacccagggctgccctcctgagtctcggccgccaccactgcagctgccacccaccactcctgtgttcacacacaacgcatcccaaactgatctcctgtgtcctagctccaaaatgcacttgcccacggccccccatctcctcagagcagtgccgtccttttggggtcttggcgtagactcctcccttgtccccgtcctccatccatcagaaaggcagaaaggccctggctctgcagccccctcccttccccccaccccgggcatggcagccagagtggtcctttccaacgccagtgctgctttccacaaaaacctagagaggactcccagtttcctgccatggagacacggagagctcatcatgccctgggccctcagcgtctggcccacccctcactccagcctgtggaccacgctggcgcagccccgctctgcgctcccaggacaccagcacctcctgcaggatcatgagcaccagggcaagacgggcggagctgacccagcacccagaacagagttggcacaaggaaggccctactggtggcactccctcaggccagcccacctgcagagcagccacctccagcctccagacccaacccgggctctgccttccctgcctccccacaaggagagcagagccatggccctctgccggggatgggagtgcaagattaggccggactcgacgaggcctttctccactctctccctggagccccagcagcggggcctgctcccgtgtctgcgaccactcacgccgtagggaggctcccagcccagaccctgtgcagggccctggcgccccctagtggagctgcccacgcatctgcttcagcttctgccacccgaagcactaggctggcccttgtcccctgccctgggagaggctcaggcacagagggcgtctccagccagaagtcacagccactgtcaccagaatggtcaccaccctggggggtgcgggggggagggcggggcgtggcgctgacacccccctcccttctaggagctggtgagcaggctgctgcacctgcacttcaaggatgacaagaccaaaggtgcgggtgggggtgcgggcgggaggtgggtccccgtgtctgtcctcagggaccctttcctgcaactctgcagggccaaggcctcgggagggcgggggtatgtctggagcacccagccagagcggtgggtgagggtcccgcataacctccccctgccttgcagtgagcggggacgcgctgcagctcatggtggagttgctgaaggtcttcgttgtgggtgagcccagggcccacgctccctccgggcacagcatccggaattttgcgtttttccagcgggaaaaccaagacgtgttttcccgtttcccacaagggcctaaacttgggtctcctgagcctgtttgtcaggtgctgtggcctggttctgggggctgcccgtgggtgttggggggggcaccggcccaggctgaggccctcactgggctcgggtttaagatccccccagcatcccccacctctcgcgtttctcaccgcagaagcagcagtccgcggcgtgcggcaggcccaggcagaagacgcgctccgtgtggacgtggaccagctggagaaggtgcttccgcagctggtgcgtgagcgtgggtcggggcgcaagtgggggtgcccggctggctggccctaagtgcttctcttccccacagctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctccca

SEQ ID NO: 37254 - DNA, 1349 bp, Homo sapiens
gcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagagtaagcacgggaggggcggcggaggggcgcgagtttgagggcgacgcgatgaatgaatcggaacggggggtggggagacgcgggatctggaggtgagtgggagaggacgaggggccggaaggaaacagggacatcgagtgtgtcccttctcgggtgcaccctttatttttgtttttgtttttgtttgagacagaggcttgctctgtttcccaagctagagtgcagtggcgggcgcgatcacggctcactgtagcctcgaactcccgatctcaagcgatcctcccccctcggcccgggtaattaaaaaaatttttcttaagacagggtcttgctatgttgcccaggctgatctcaaacacccgggctccagtgatcctcccgcctcgaccttccaaagtgctgaggttacaggcgtgagccactgcccggccaggtgcaccctttgtacaggaaaaggggtaggaaaggcttcgaggtccctctgagccctctgatcgcgtccctttcccacgccagggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagtgtcctgcc

SEQ ID NO: 37255 - DNA, 235821 bp, Homo sapiens; identical to SEQ ID NO: 36973

SEQ ID NO: 37256 - DNA, 186231 bp, Homo sapiens; identical to SEQ ID NO: 36947

SEQ ID NO: 37257 - DNA, 186231 bp, Homo sapiens; identical to SEQ ID NO: 36947

SEQ ID NO: 37258 - DNA, 3311 bp, Homo sapiens
aagatttcagctgcgggacggtcaggggagacctccaggcgcagggaaggacgtgaggaggggaagcgggctggggcggcagccgggcggaggggcagctgcgcaggcggaatgaggaacgcctttgctctaaggcgaccaccctggcagctcttcactgaggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaaggagggaagattttgcctgaagcgggaaagccaagggctgggcggcgcgagacccccattcctagcgactggggctggctggtggcccgcggcagcccccgcgccgggaggattaggcctcccgccgctcccacccgtccggaccctcccacgtgtttaggtcctcccaaaagtattcggcctccggcccctgccccttcccccggctggcctggacctcggggacgtggggggaaccccgtgggagcagggggattctggacggggagggagtagcggttggggagaaggctgagcggggaaaggagagaggggctccggggacggcagggaggagagtgggtcgtgccggagacccagggagagacacaatgggcaagattaggggtgtagggtgggagtgcgaactgactgattcctagcgtgggcagggaactttgctaaaactgcaggccccagggaacagcgcgggcagggtgggagggaacggagagggccaggcggaccctaaggtcaatttggagaaagggccatttccaggctccttcacctgtgcccagcgttctacaggcctggaccccgcccccgctccccaccctccccccagagcagggcgcgggaggaggcggctcgggctggctcggagagctgaggggcgcacacccgcttcgcagggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacggtgagtagcatggcccgggcaggagcggggagggtcgtaccccaggagaccagcgcattcccacgaagggggacagaagtgcttgggctctgagccccagccctttggagaaaaggccactgtccagcctgctggaatgtgactgcgtgagggaggtgcggatcacaccagggcttgctctgcaccctcagctggctaccggccatcctctgcctgcctgtctgtccgcagcccttcccagctggaatatttgtgaggctggaatttaagctgcagcagacaagctgccggaagagggactggaagaaacccgagtgcaaagtcaggcccaatggggtgagtgaaggggtgtgagagcaatgggcgcatgctgggtgtgagtgcatggacttggggtttggggtgtggggcacatgcctgggtgtgcatgcatgaattgggaggtccattaagaagccctgaggttagagaccccactgcgaagagcctccttagaggtggagtggctcagcctgagcccaaggttgtgagagtggctggtgggagctggggcctggcagacaggaagatggtttggttacccctggacttatcttcatcagagcagggctcacctcggtctgagttcctctctcaagcatcagggcctgggtggaaggagccggctgtgtgggtgtgtctggtgcccccctagcctagcaggactccagtcatcagtcacggtgggggcaaaccttccaccgtgggggtgatgcctgggctgggagtgcagtgactgtgttctagttcccgctctgtgagcacggcctgggctctgtattacaggttctgcaaaggccccagttccctctgtcggctcaaggagggcactggactatagcaatgattcatcaacctcaaaatcaaatcttacaagaaaataaatagaataggtgacagctgagccactctggaggcgttgggtgggaagaacccatcggaggaggattcttgccttcacacgagcacaagcagacacatccatgcatacatcacacacccatccacccacactcctgcatacaaaccacatacatgcgtgtttatgcatgtgccacacaacccatctgggaaggactcctgcctgcacacacatgaaagttccatagtttgaaaactgcatgggtctgacttctgacattctagggtggctgtgcctgaaacctgctggcctgcatgacctcttgctcctgggctcgagggcctagttggggatctggtcccatgatgggcagccctggctcccaccctcatgatgcccaggcctccctcacccttttcctctgctcaccccatgctccccgctcccccacagaggaaacggaaatgcctggcctgcatcaaactgggctctgaggacaaagttctgggccggttggtccactgccccatagagacccaagttctgcgggtaagaaggggcaagggtgcacaggtggtgacagggctgggaagatggatggaagctgagcctatgggctggtctcgaggctaaagcttggccaagcaggagggagggcagtgggggctagaaagcgctgtgcctgtttggacattctccaagggatgtggaggggatgtggaggatgctggcagccctccactggcactgcccacccctcctacactgcctgaacagttttgggcactggcaggaggctgaggagcaccaggagacccagtgcctcagggtgcagcgggctggtgaggacccccacagcttctacttccctggacagttcgccttctccaaggccctgccccgcagctaagccagcactggtaggcaccagggggctgagagcaccgtctggatgaggccagccctgggaatgctgaggggctgggctgggctttgggagcctgggaggggacaggtcagaagcctgggaggaaagctgggactggggctgaagcaacctccctcacccccaaacctgtttccccttttgtctagagatgcgtggtgcctccaggaccgctgcgggtggtaaccagtggaagaccccagcccccagggagaggaacccgttctatccccagccatgataataaagctgctctcccagctgcctctc

SEQ ID NO: 37259 - DNA, 21172 bp, Homo sapiens
acagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacaggtgaggggaggacaccctgggaaggggcggaaagagggcgcacagagaatggctagggtcctctggggaggatggagctctaagaggggacagagggcttctcttggagccaaataggagagaggacatgaaagggatagagatcataaaaggaaagtctcagtgatctgaaactgttagtgaataaacaatctcccattttttaccttttccaactgaatcatcaatgagcaataaatttcaaaaactgctgacaataatcacaatttaagtcagcgtgacaattaaggaaaacattttaaaaggggcattaaacagagccctgagccaccaacctcagatattggcaaataaaccccaggacatgaagagccctgggaatgctcactaactcatccacaggagtctgcagcctatcccaggcactggggtgcaaccaacatcacacaaatccctgccctcacggagctcacgctctcatgggtggggaagacagacaagcaaagagatctagaatgtgaggtcaggtgttgacaagagccctggagggaacagagcagaaaaaggtcagaaagggaatacccagggtctctaggggaggtgtcagggaaaggatctcccaagagcaccctgatgtgatcaagatctgagggcagtggggagggagccatgcggatccctggggaagggcattccagagaaatgacaaggtcagaggcactaagggaatgggagtcacactgctgaccttgacccagtaggacacacacacacacacacacacacacacacacacacacacacactccaaggtggaggggtgaagacacctgctcaggacccaaggccccatttttctaccctaatgcataggtcccaatattgactgatgctctctcctctctcctagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtataccgtgagtatttccccatgacctctgggtgttggggggttagttctacttcccacacatgggattgtcaggcctgggctgtgcctgtgtcctcctctgcattataccccatgttaaggtttgagcatctagtgcaggacacactatgggacagacatcaaaataccgaatgtcttactctggagtcctgatcctgcagacatttgcttcagaggaaggacaatctgatgtgggtaacttatcgaggggagaccagtctcaatctagccccccgggaccctcctggtgaacatgtccctaagaaagacccagtaggactcagtcagggtctggcctgaagggccttctgggatcctcacagacaagctcagccctgggaatcccctgctccaaaacactatcccaaggttctcaactcctggtgaccctgaggagcctgggccagggctagattgtggcctcctgggcagggctgactaggaacaagaatttgagctatccgagggctgtggctcctggagctggtaaccagccagggttcaggcactagagcctcatttgggcaaggatggagcctcatccttcaccttagtctcagcctggagaggacagatggacaagctccccaggccatcagccaactgccctgggggcttaggagatgccataggaagtttaccatccccaggaggaggaacagaggagacaggatgctcctgaaagctccttgtccaccagggatcaggctgagaggcactctcagggaatccaacaacaatagatgctgcggccgggagcggtggctcacgcctgtaatcccagtactttgggaggccgaggtggatggactatgaggtcaggagttcaagaccagcctgaccaacatggtgaaatgccgtctctactaaaaatacaaaaaaattagccgggcatggtggtgcgtgcctgtaatcccagctactcaggaggctgaggcaggagaattgcttgaacctgggaggcagaggttgcagtgagccaagatcacaccactgcaccctagcctgggtgacagagcgagactccatctcaaaaaaataaaataaaataagattgtttatttgggcagctcccctatgcagagctgaggtcaaataattataaatattttaaggttaattcacagaccacaagataagccaaaaccattaaccatttatactatttcactgaggggaaactgagccacatggcaataaatacagtcactatatcaaggtcacacagaccgtaactggaagatcagttacaggagatttgtcttcagccacagtcttaacctctcctctactccaggggccttatttggcatctgtggaccccaataccagagttggttcagttcctttcttcttaggcatctgcagcccagaggggagatcctggtctggggagtgagatcaaatggagaattaaccaagttttattctggaacttattcaacaattagagtcagtgtcagaaatgttcaggcctgggtcaggtgtggtggctcacacctgtaatcccagcactttgggatgccaaggtgggcggatcacttgaggtcaggagttcaagaccagcctggccaacatggtgaaaccccatctctactaaaaatacaaaaaaaattagtcgggcatggtggtgcgtgcctctaatcccagctacttgggatgctgaggtggtagaatcgcttgaacccaggaggcagaggttgcagtgagccaagatcatgtcactgtgctccagcctgggagacagagtgagactctatctcaaaaaaaaaaaaaaaaaatgttcaggcctatcccctcagacccacacctctgctccctggacttgaaatcctgtgtttcctgatgtgttggtgtcactcccacaggaggataaaggaaaggactttgctttctctcctcactcacaccctgcaccagccagggcccaatatgaaacacacactcagtagttctctcacgaatgaatgaatgattgaatgatccataacctctttagagactggatctggttgcagaatcctgggaggttcttgccatacctgctccccatccctccagagactgagacccatgttccatcccctgaccatctacccctaaagccaccccaagtaccatatttcatgtgactctggggctgctcggctgtgggaaggttttcagggctccctggtcttggttctgggacaccagaggctcctggttgctggggtctctaaggtcacttagcccccactgctcactgtcatgggcatctctgactctctctgctcctccatgtcctcattttcctctccttttatcccagctgaactgcacagtttcctccacccttaggcctttcccagacactccgtctaacaaggttgactgtcctgttcccttcccgctcacactgtggccaggcccacctcccaggcaataggaaaggcacagaaatgagcccagagcagccacccctgccaggtccatcataagccactgtccccacgtccctcagtgaggctgacatgtggaacaggccaggggacagggacgagcgactcctccatacactctctatactgactcaccaggggatcagaggcagaaggacaggtctgcagtccccaaagcccatgggctcatttcacccatttgactcctaactccatccctgttctgctgtgggctcacatcctctagtggttcctgggaccttccccaggtagagctagccaggcaggtgctgtctgatgggtttgctgcccattccacctacacctgtgtcctcatgatgacaccattgtcataaggtgggatctctcagacagggagatgcattagccactggtgtctcacttagactctgcccaatttggatgaatttggtcaaactctagttgtgtttcctgaggttgagagaaaaggaagaaagcatttcacatgactgttttgggttcctctttttacctgaatttccacaggaatttgtaacatagaactctttctaaatttactaacataacatacatcacttctcctcatatggcatcgtttctctcttaatgcaattgagaactctcagatatcctttctgacaagttctgtcttcctaacaggacccatgagtcccttctacccagggagtcactgatttcaaactgacttcagcatctttctttgatcataacatgatcctactggacttcagagcttggtttaagagtttatcacgctctctagagaatattcctcttattaattggtgttagatccagagtattaataacaattttcacaaatggaataatttaacttctcaaatttatatcccagatctaccaaacacacacggtccatgagggtcaggctttcagcaagttcatgctccttccgttccactagctggttattctgcatttgcaaaaaacccacatatttcagaaaagatccacagtgtcatcatctgctcttttcagggggaaaagggacattaaagaccaaagacaaggaacgtagatatgctgttaaatccaggcagcccctgcctgtcaccctcactcttttctagatcattccttggactctgctctatctttagggggtcactggctcaagtcagtcatcatcaaacacctgggaaaaactgccccaccttgtggttctgctgcctgacgactgagctaccttcaggcttgcccctggtgtcccctgttatttctgctgaaacatacagtcccaggccaggctgctcagtatcctcagggtttaaggacaataggaagtcccatcatcacccatctctaggatgtcctcagacagggaagctgcagagaaaacacacctagtggggcaaagtaggactgtgaagctggaagggacccagcacctgtatgttccaggtgaggacccacaggtgggtcaggcaggcatcagccagtcagggaaggaccagaagtgcctggggctgtgactcccagtcctcggtctgtccacgacccaacactgctgctcagttcacacttgagaaagtctgtgcttctctcacacagagcaggcggcctcacggtctctgagccctcagatcattgcacatctgtcttgtgaaacacacacttgccatgggcttttagggacttgggttggctgagaggtggggagatgccaactctgattgaaaaatgcccggacggaatcccagcactttgggaggccgaggcgggcagatcacgaggtcaggaggtcgagaccatcctggctaacagtgaccatcctggctaaaatacaaaaaactagccgggcatggtggcatgcacctgtagtcccagctactcaggaggctgaggcaggagaatcgcttgaacccgggaggaagaggttgcagtgagccaagatcgtgccactgcaccccagcctcagcaacaaagcgagactctgtctcaaaaaaaaaaagaaagaaagaaaaatgcccagccaggcacggtggctcaggcctgtaatcccagcactttgagaggccgaatcgggcggattgccagagctcaggagtttgagaccagcctgggcaacacggtgaaaccccgtcaggcatggtggcatgtgcctgtaatcccagctactcaggaagctgaggcaggagaattgcttgaatccaggaggtggaggttgcagtgagccgagatcgtgccattgcactccagcctgggtgacagagcgaggctccatctccaaaaaaaataaataaataagaaaagaaaaatgcctgtggaggaatcaaaggtgccacacagggcaatcttctctctgttttctgcatagcggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctgtgagtatcttctgttcctctgtggcccaggctgccagcccaaatccacgcagccagaggccaggcctctcagtccctctcaggtctaaggacgcagacccttaaccctggacacccaggctggccatgacttcctttccccaggcaaacctgggcagccccagcctgaaccaagaataggaggggagaggctgctcctgtcctgggaggctcagggtccacagcctgtgatgggagaaacaggtgaatgtctcagacccagactcagtggacacaatggaggtttggttaggacttcagggttgtgacttagtagagaggaacactgtggcccttctccagaccagcagcttccccttccctctgatgacatcacctgtggctttattctctttgctccagatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactggtaagtaattcctggagcatcaacactaagatctggggtacaagctttctggttttcaaataggagcagagaagaaattttcttttgcagcctgtatccaacaggcacaaacaagtccaaattctcccctgaaccctctcaattcatctgtgcagactctcttccctttgtttttctgatttctcacagctgaccttaggtccagcctggaatgtggggagggggttctctcagccccagaaagccccgtgtagcaggaggggcttcacagagggggaagcagaaagggtcctcaaggtcaatttgcttctgtcactaacatgtccctttctgtaacttcttggccttcttttacctattccatgagatataaggaatatgtgaggttttaaaacagactcacaatagttttccctaaatgagagaaggaaatgcccttcatcagggatgagcagctcagactctgctccctgctctactcccggcttgcccggtgattggctctgccctgatcccatgtggggtaggacgcaggtgtgtgcagaaggtgtccaggtggcctgtcatgaatccagctaaatcaagatggcagtcaatggctgggcgctgtggttcatgcctgtgatcccagtactttggaaggccgaggtgagaggatcacctgaggtcaggagttcgagaccagcctgaccaacatggcaaaactccatctctactaaaaatacaaaaaaaaaaatttagccaggcatggttgcacatgccactaggcatgccactagggaggctgaggcacaagaatcacttgaacctgggaggcagaggttgcaatgagccgagatggcaccactgcactccagcctggacaacacagagagactctgtctcaaaaactaaataaataaataaataaaggcagtcaacacctgagcctcccctgggtcaggctgcctccctgagcttgtcctggctctgaagtcaccagctgtatgaggctgtgggcacagcacatgggatagcacagagcacagcgagtgacccacacttggagaaatcgggagattcagccacaggggctctgcattggagagaatgggcaatgccaaacagcgtgtatttgtagagaaggtaagaatatcagccttttgttaacactgtgcctactctaggaatctccttcaccgtgatattctatccacagaccaggaagtaaaactcctctttacagtgggaaatccttcggattggaactccagatagtaaggtcatgaagactggatggggcatcatcattccctaaaaaattatttaatgaaaaaaaacactaccttcccttttgtatgtaaagtgacagtcacaggaaggatgcctgatcacagctccaggaaagggtcagtgggaggccaggcacagtggctcacgcctgtaatcccagcactttgggaggctgaggcgggtggatcatgaggtcaggagatcaagaccatcctggctaacatggtgaaaccccgtctctactaaaaatacaaaaaattagctgggcatggtggcacatgcctttagtcccagctactcgggaggctgaggcaggagaatggcttgaacccgggaggcagagcttgcagtgagctgagatcatgccactgcattccggcctgggtgacagagcgagactccgtctgaaaaaaaaaaaaaaaaagtcagtgggaaaaacattctacctgatgatgaggttgctcggtctgtgcgctgagaagaagattccaagtggagatatagagatatccagagggtcactctgagacgatctggggtcaggagggaggtgcagccctctccttacaattcatcacctgaacaaagacactcgaccttctgcagagggtcagggctatcccctggttggtgacctttgcacagctcactgtgggacctgagagctggctaaaatctcagggaaaggagcatagccctaggccccaggccccaaccctattctcagtaggttatctcagatactctgcttgtccacagagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactgtaagtgactcctcaccccttcctatatgtccctctaggattactctgtcaatggtgtgcaaaatggataaaactcacaggaggcagaatatcaatgaagagaccattatagcaaacagaattgcaaagtggttaagagctcagctcaggccgggcacagtggctcacgcctgtaatcccagcagtttgggaggccaaggcgggcggatcacgagggcaggagatcgagaccatcctggctaatatggtgaaaccccgtgtctactaaaaatacaaaaaaaaattagccgggcatggtggcgggcgcctgtagtcccagctactcgggaggctgaggcgggagaatggcgtgaacctgggaggcggagctttcagtgagccgagatggtgccactgcactccagtctaggcaacagagcaagactctgtctcaaaaaaaaaaaaaaaaaaagagctcaggctctgaatcaaatatacatatacttagttggttttttttggttggttgggtttttttgtttgttttgttgttttgagacagggtctcactctgtcacccaggctggagtgctgtggtgtgatcaaagctcactcccgcctcaatcccctgggttcaagcaatcctgccacctcagcctccagagtagctgggactacaggttgcaccaccatgcctggctaagtttttaagtttttttgtagagttggggtttcactgtgttgcccaggctggtctcaatctcctggtctcagcctcggcctcccaaagtgctgggattacaggaatgagccactctgcccaccccgtatttaactattctaagtacctctcatacagatggaagcatgcaatatttgtccttttgtgtctggcttacttcatttagcacaatgtcttcaagctccatctatgttgtagaatgtatcagaatttcattccttttggagactgaataatattatgctgtgtagatagatacatcacattttgcttatccactcatccatctatggacagttaggttgcttccaccttttggctattatgaataatgctattacaaacatgggtatacaaatatctgttcaaatccctgctttcagttcttttaaatagatactcagaagtggaattgctggatcaaatggtaatcctgtttaattttgaagaaccatcataccattttccacagtggctataccatttcacattcccaccagcaatgcactagagttccaatttctctacatcttcaaaaacatttgttgctttctggttttgttttgttttttataatggccatcctaatggttataaggtggtatatcattggagttttgatttgcacttccctaatgattagcaatatttagcatcttttcatgtgcttatttgccatttatcttctttggagaaatgtttattcaagtcctttgcccatgttttaattaggttgtttggggatttttggttgagttgcagtagttctttatatattttggatattaatcccttatcagatatatgattctcaaatattttctcccattctataagaagtcttttcacttttgtgataatgtgctttgatacacaaaagcttttaattttcattaagtccaatttctctacttcttctttcgttgcctatgcttttagtgtcatagccaagaaatcattgccaaattcaatgttccaaagttttcactctatcttccaagagctttatagttttagctcttacatttaggtcttttatgcattttgaattaatttttatatatggtgttacataaaggttcaatttcattcttttgcatggatatccagtttcttcaatgccatttgttgaaaagactatcctttccccactgaatgatcttggcacccttgtcaaaaaacatttggctatgtatgcaaacatttctttctgggctctatattttattccactggtttctatttctttttgccagtaccatactgttttgattactgtagcttttggattttgtttgtttgttttattgttgttgtttgggtttttttgttttgttttgtttttttgcttttctttgtagagatggcgtttcaccatgttgccaaggctggtctcaaactcctgagctcaagcaatccacccgcctccacctcccaaagtgctaagattacaggtgtgatgattaccatagctttgtaaaaaattttgaaaccaggaagtgtgagcccttcaactttgttctttttcaagattgctttggctatccatggtcccttcagagtctatataaattttagaatgaatttttctatttctgcaaaaaatattactggaattttgatagagattgcactgaatctgtagatcactttgggtagtactgtcatcttaacaatattaagtcttctaatccatgaaaatggggtgtcttttcaatttatgtcttatttaatttcttttggcaatgttttgtattttcagggtacaaatctttcacctctttggttaagtttatttctaagtatttttaaagctcttataaatagaatttttttcttaattttcctttgaattgttattagtatacaaaaatacaactgatttttgcatgtggattttgtatcctgccactttgctaaatttattattctaacagtttttttgtggaatctctagggttttctatatataagttagtgtattctgcaaacaggtataattttacttctttccaatctagatgctttttttttcttgcctaattgttctgtctaggtcttccaatactacattgaatagaaatggcaaaagcaggcatccttgtcttgttcttgatcttaaaggaaaagttttcaatctttcaccattgactatgatggtagctgggggttttcacatgtagcatttattatgttgagaatttccttctattcctagtttcagtgttttttagcatgaaagaatgttgaattttgtcaaatgcttttatcgactcattttcattactggttataggtctattcagattttctatttattcatgattctatcatggcaggttttgtgtttctaggaatttgttcatttcatccaggttatccaatttgttggcattcaattactcatagtactcttataatccttattatttctgcagaattagtagtaatgttttactttcatttctgactttagtaatttgaatcttctttctttcttagtcaatctaattaacagttgtcaattatagtgatcttttttgaagaacaacttttttttttcggtttgagacaggttctcactctgtcaccgaggctgatcatggctcaccacagcctcaacttcccgggttcaagcaatcctcctgcttcagcctcctgggtagctgaaactacagacaagcactaccacctccggctaatttttgtaattttttgtagagacagggtttcaccatcttgcccagctggtctcaaattcctgagctcaagtgatacacctgcctcagcctcccaaattgctgggattacagtcatacaccactgtacctggcctacagttataaatttctttcttgcacaagattcttaactactctgagcctcggattcctcaaccgaaaattgcactgtgaatgcctgctccatagtattgcacgggtttggggtttttgttttgtttttgagacagggtgtcactctgtcacccagactggagtgcagtggtgcaaacacagctcactgcagcctcaacctcctgggctcaagcaattccctcaccttagcctcctaagtagtacatactaccacatctggctaatttatttttatttttgttttcagagagacagaatctcaccatgttacccaggctggactcgaactcctgggctcaagcaatcctcccatctgtttcccaaagtgctgagattacaggtgtgagccaccacgcctggccccatagtgttattttaaagatttaatgtaataataaaccttcagcaaaacaccacacacagaggaaatgtttcataaatgttagctgctattactactactattatcattagccttgaaatcaggtagtcctagggtcaaatctcagatccacctctcactagccatctgactttaggtaagccttttaccactctaagcttccattttttcatgtttaaaatggaaataatgtctacctgacagcactattttatggatcaaataagatacatgtaaagcatttagcagcacagggcctggcacacaggaagtactccacaaaagtagctaacatagcattagtcaccagcctgagttgactggtgagggttaagccccaaatagttgcaacagatataaacaagaaataggctagacacagtggctcacacctgtaatcccaacatttgggaggccgaggctggaggatctcttgagcccaggaatccaagaccagcctaggcaatatagtggaaccctatctctacaaaaattatttttttttaattagccaggtgggtgggcgtggtggctcacgcctgtaatcccaacactttgggaggttgaggcaggcgggtcacctgaggtcgggagttcaagaccagcctgaccaggatggagaaaccccgtctctactaaaaatacaaaattagccaggcgtggtggcgcatgcctgtaatcccagcaattcaggaggctgaggtaggagaatcgcttgaacctgggaggcagaggttgcagtgagccgagatcacgccattgcactctagcctaggcaacaagagcaaaactcggtctcaaaaaaaaaaaaaagaaagaaaaaaattagccaggtgtggtggcatgtgcttatagtctcagctactgaggagactgaggtgggaggatcacttgatcccaagaggctacaatgagccatgattgtgccactgcactccagcctgggtgatagagtgagaacctgcctcaaaaaaaaaaaaaaaaaaaaagaagaagaagaaatagatgcaaaaggtattatttatatattatatatatatatatatatatatatggagggagaagcattatacaagaaacccactgggacatggctatgatcaaatatgggaaagggggaaaaaaggaggtaaagcaaagtctcaagcctggtatgttagtttccatctactgagatacagtgaagatgggattaaacatacgagataatttattggggaaaatgcctgtgagggaaagtaaggcgagagtgagaggaacctcagaccatgatgcagatctgattcctgtggaagagaaagagaggaaggaagttttagattgaagtgcagtttttgtttgtttgttttttgagacagagtctcactctgttgcccaggcttgagtgcagtagtgtgatctcggctcactgaaacctctgccccccgggttcaagcgattctcctgcctcagcctctcaagtagctgggattataggcacctgccaccgcacccagctaaattttgtatttttagtagagatagggtttcaccatcttggccaggctggtcttgaactcctgacctcgtgatccacccgcctcagcctcccaaagttctgggattacaggcgtcagccaccgcgcccggcctgcagtgcagttctaagagcatttctgcaaggctgacagggagtcctccagccattcacacttcagaataaaacagtcacacaaaactgggctagctttcatacccctgctgggagcctgtgggaagccagttctctatgcaaaagaggtggtgaattcagaatgcaccaactgccacaactgagacactgagaaaaagatgcaaccacgaaaaaggtggaaagttctaatcacatacaaaatagcaatcagcctttctcatatttcaaagccttaaaaatggctgagcgcagaaaagccagggtggaattggcagaagagagatcatcaacctagaaacatggtgactggggttgggcgcagtggctcacgcctataatccaagcactttgggaggccgaggcaggcggatcatgaggtcaggagttcaagaccagtctgaccaatatggtgaaaccccgtctctactaaaaaaatacagaaattagccaggtgtggtggcacgtgcctgtagtccagcctgaggcaggagaatcgcttgaacctgggaggcggaggttgcagtgagccaagatcatgctactgcactccagcctgagagacagagcaagactctgtctcaaaaaaaaaaaagaaaagaaaaaaagaaacatggtgattgaaaaaaaaaaattgcaaggatatagttagctaatcaccttccagcaaccttcccacaacgaaactgtattccttgaaggaacaattagaaactacttcattctgagagttgtttcccagcccccattgtaaaataatttcactttcatttcttctcctcttttctctccatgacagataatgctctaccacaagaaaatggcctctcacctggggccattgctggcattgtgattggagtagtggccctggttgctctgatagcagtagccctggcatgttttctgcatttcgggaagaccggcaggtatgatggcctttcctcttgttctgtttcctccaaggctgactgccatgcttgggagagggaaagaattctttgcctgtctctgggcctggatctcatactcctcccactaaactcctgcttctcggcactaattcccacaggtttcctcttccctggtcttcgtgctccctgtctcccattatctcttggacatgggtattccaatccccatctaatctagaggaagagactcaagtatgttcctctgtcccctagtcagggaaagcaaggtctaagaaggaaaacaaatgaaaaaatgaaagaagcagcaggagaaagcaagtcatgtgctctgttgaccacattggaagaggagggagaaatagcataggaagagaacctaagagaaagcaaaaacaaccaaagtcctcttgaacaataaatagagaaaaaaaaaaaagtatctaccccggaaaacaaaatgggaaaggttttaaggatagaagtaggcacagaagcagctgataaagaatgaaatgaaatgtgaacatccagcaaacaggaaaagagtaaacactagaagggattgtagttagactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacagtaagtaaagccacttaccccagtgagaactggtatgttccaccacgtgccctcccctggcagggaatcctggattcccaaaccactccctcccttctgaattttcacagaaaggatctctatttcccaaccctaaggtggcataggtcttcccacccttcctagccacaggagtcccctgagacacatctgaggagagaggctcactctgcctaggccaggcaggcctgaggaagatcccatgtttccaggagccatttcctcagccttactccttccgcctcctgcctctattacggatgtgggcactctcccttggtgagactttccttatcttgtgggtgctgtgggtgctacaagtctcaatgcccctccttgccactggagcatgttgctgagaaacacatctgggcaaaaatcaaggccttgtgaactggtagaactcttcacaagtggattgtggcctcctgtggttctgcccctgccccctctctggtactaacatgctgggtctggaccatacactctgagggaagtaaattccttaactgatccttaaactccccaccctccaactgccacctccttcagctagaatcacctgaagtcagctttgcatttccatggatcgctaactcttcttttgcttctccagctcaggaccactccaatgacccacctaacaaggtaagcatagccggttttcatgggcttattttctcatggaaatgattctgtgtagaattgattattcatgaagacacaatgtaacatcaagtttgggttaatgttcctcagtgcaacaacaaagacgtatttgtaatcactcccatgagtctactttgcagcaagaacatgcattttggaattattcccatcctgtgtctgaatactggatgtgactcttagtagctctgtgacccttgtcaagtaacttaacctctttgatcatcagctttgtcatctgtaaaatgggcattctgcctacttcaaagagaagttgaagggattaaacgagataacctacaaagagcacccagcacaatggcctaaaaaaggaaggcactgaatcattctcactcccctaccttcagtctgatcctgctcttattgtcaaaaggataatttcaattttaatagatctgagatcctgttttttaataataattttatagaatttttcattttatggccaggcacagtggctcatgcctgtaatcccagcactttgggaggccaaggcaggtgaaacacaaggtcaggagatcgagaccattctggctaacatggtgaaaccccagctctactaaaaatacaaaaaaattagccagctgtggtggcgggcgcctgtagtcccagctacttgggaggctgaggcaggagaatggcgtgaacccaggaggtggagtttgcagtgagccaagattgcgccattgcgctccagcctgggcgacagagggaaactctgtctcaaaaaaaaaagaagttttcattttaccttttcaatagagcaaacatacatactgaaaagtgctaaatcataattatactttcacaatgtatgaactttcacaagttgaacacacccaggtaagcagcacccaaatcatgaaatactacatgacctccccttaaaaagagacccttccagccaggtgcagtggctcacacctgtaatcccagcactctgggaggccaaggcaggtggatcactagaagtcaggagttctaaaccagcctggccaacatagtgaaaccttgttctactaaaaatacaaaaaattagccgggcgtggtagtggatgcctgtaatcccagctacttgggaggctgagacaggagcatcgcttgaacccgggaggcagagcttgcagtgagccgagatcgtgccattgcactccagcctgggcgacagagcgagactccgtcgcaaaaaaaaaaaactctaccagtcacttccctccaaagaggagtaaccactatcctgacttctaatgctccagattagtattgcttggttttgttcctatctaaaggagaaataaaacatatccttatatgtggcttcttcaacattgctttgtgagactcatccatattgtatgtatttgtggtttgctggttctcattgctgcattatcctatcccattgcatatataccataatttctctcttctaatgatcattcatcaggaggtcagcaagcagagaatgggtaacaacaaaagcccttctccagagctaaaatttcaaaatggtaacagcttgtggtgctgaatcacaccaggcaaggtgaggccctgccctgtgtcactgacttaactgatcattatttgtgcttttcagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcg

SEQ ID NO: 37260 - DNA, 28682 bp, Homo sapiens
gccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaaggtgagggcgggggcgccccgcgggcgggcggcggcctggcccgggaggcccccgctgcgaaactgttaaaaagttgctttttgtggcggcggaggatgcaggtgccgggaagggctcaggctcacctggcggctgggccggccgtgcccgcggatcccgcccgcaggaagcctcggcacggggcccacggccttgctaatgcgcagttgaatatcagccccgaggcgcgtgggggccagggacgagccaggcaccgttttaagcgctttccgtggattagctagtttaatcctcactgcattcctccgaggcagacccgggtgagccagtgtgtcccgcagtaagtggcatagcccgagaagccgccccgtcgcaggctgtctagcccagcgcctttcatggccagcgtggagggccggctgctgcaggtggtagttgttttgcggcgtagcgggagctgtgcgctccgcaccgtaactccaggagacagtaactttttaaaaattaatgtttgagggtacatggtaggtgtatatatttgtggggtacatgagatgtttggatacaggcacgcagtgtgaaataagcacgtgatggagaacggggcgtccatcccagcatttatccattgaggtacaaacaatccaattacacacttttgttatcccattttccatatgaggaaagcggagattaaaacggtaaagtggcttgcctaaagctaagtgtgggagggagtgttttttgaacccacacactcagaagaagagttgtagtcactgctcaaaccccatctcttccttaccatcctagtttacagtttttttcagttgggcgttaagctgttaggcatagttcaccagatgccaattgaaacgacagaagaaagagcgcatctatctctgccacttttcttcagtttgcacgccagctttcacttagaaacaggcctgccgatggtgtctccagagaacaatcgtagagtagcccactctttggggccagtggggcccctgtttttcttatactaatagcaggagctagcagttggggaacactttttatgtgcctaacactgataggcccataacacagttgctcatttaattctcccagtaacacaatagaggtagtaatgttggggagtgctagggttctccttaagactccagagcaaacgttcttaaccgctatactgagtactgaacaatcctcaggaatttttccaggcatcttcagtttctgcaattctgtgtaaatgctctcagctctaatcttgcaatgaaaattaacatctcatttagttgaatattaaatgatcatgttgcttgttcatgctaaccactgaacatggcagaagaaaagaatgtagacctgaataactcagaaaaggaaaataaaatgagcacctcttttggaggaagataatttcttaaattaacatgcaatcactttaaccaaagtaattcacctttattacacttacagagtccaagctacttagtggttgcagtgcagtgtttggcaccatcttctttatgtccaagagacaaatttattatacatattaacaaacctgttttcagatttccccgtaaggattgatggcctagtttgatagtttctccaggatttgtgaggcaaccactgtaccactgcagtacttccctataatttaatttgtatcatcacaactaaatatttctctttcctgtatttaagaagcattaatctttaagggcatagagggggcaggttcttttttcttgtgtttccagcatctagcataatacttggcacatactggaagctcgattttaatatttgttgaactgcactgaagcactcgcacagaattgttttcatggctctcttccatcaggtgccttagtccacgctgcattctcccgctgtgggaggttgttaggaacaacagctgtaacacttcaatctaccgagcagcaagtgcaacgtgtcagggttacacgaggaattctctttaacctctgatcaaaataaagtcatcagctcttcaagtttaaccttaaaaacacaggtctgggctgggcgcagtgactcatgcctgtaatcctagcactttgggaggccgaggcgggcatataacctgaggccaggaattcgagaccagcctggccaacatggtgaaactccatctccactaaaaatacaaaattaggtgggtgtggtggcaggcccctgtaatcccagctactcgggaggctgaggcaggagaattgcttgaaactgggaggcggagttgcagtgagctgagatcgtgctattgcactccagcctggatgacaagaacgaaactccctctcaaaacacacacacacacacacacacacacacacacacacatatctgaacctctttactgccagttgcatttctgtgtttttcaaagggctgttacgttatcacagtggactttgacttaaccctctgtgtcataaccaactatatggagtacgagtagaagatgtgaaattccaacaattgtaacttgtgaatatggcctgtcaaagaataaaggctacagtgtgaataaaagggtatcctttccccagttttgctaagttatatgttaactcctaaacttttaacagattttaaaacttgttcatttctcaaaaatgtattatctgctctttgccaggtattcgcctgggccctggggccacagcacctccccacatgagtggataggtaggattcctactcccatagagtgaatgttccaggaatctgttcactagagaagcctggaggtgccgcctcatgggatgtgcccactacagcgcctcgtacattgtaggccctcagtagacacttgctgctgaattaagtttgggagcaggtctgtcctgttaaacagattattcagcaagtctagtgggattttatgtgcaggcatctgtccgttttttaacatcctcattattattactgagcaaggcttatttggagagaactgcttaaaactttttttttttttttgaggtggagtctcgctctgtccccaggctggagtgcagtggcacgctcttggctcactgcaatctccgcctcccgcgttcaagccattttcctgcctcagcctcccaagtagctgggattacagacacgtgccaccacacccagctaatttttgtatttttagtagagacggggtttccccatgttagccaggatggtctcaatctcctgacctcgtgatttacccgcctcggcctcccaaagtgctgggattacaggcgtgaaccaccgcacctggctggaaaacaacttttaatgatcctgttctcagtatcttacaactatagaatgttttcctttagcagtagtaagccatgctctgaatagattgaatctttgtatcaaagtttcctagggtatccgtttttaaattgaaattgctggaaatttctaacctcagtaaactctggtctactattcataccttgttagaaacatgtaaagcttttgtgtaggcaggaggagaaaaccctttgctgttacaaaactctttgatgaagagactgtcttttgtcagagagctgagttggctcagtaggaatactgacaataatctctgtgggtaagatcttttctgggacagcaggagccttcagtgcaggtaatgatggtgcttgctttgaaacatgcccctgagaacaaggtggaaagacttcagagactggattttcttttaaaccagctgctattgtcatttggtgagctgtgcaaacttagaataaggattcaggtttctgttatgtggatcagtaaatgaactcttagtttaaaggaatcctaaaattgcaggatgagtacatcctccttgtgtacaactattttgctgaatcactgtttggagggttattaaaactgacaacatcatttttcttgatatttatattcaggttttctgctttcccaattatagtaacattggcaacaggagttaaacagaagcatcactaaatgacgcatttgactttgtaataggaaaaactttcagccttactgttagtgaattactcctacagactacagctgccagtactaattttttgcctaaagcatagagctgagtatctgtttaaagctaacagtttacaccattaaaaatatattattacctgcaaagactcattagtgaaagaatattcaacatatgaaggtattgatatgttgaaattctcaagcctgcaataaatctacagtatttttagtagttgcctaaaccaggccagttcaataggatttagagaagaccctcttaatgaaaattcattttgtaatcctgtagagatgaacaggtgtataaggcttcgaaactatattatttccttttcttttgtgccttaattaaaactataagggacattcaatattctattccctccactaattatttagaaaactttcttgggcttactgccagcttttggcctcttttggttatggaagccagctgctactcaacaggaaatgaactttttttaaagacaaagtccggtgtctttaagctaacagatgaagtaatatcctgttatacagtgtgacttcacaggagctttcttgtagttgggacttgttaaaattctatccttaacagcctataaatatttaggagatcgagacttcaggtttctgagccaggctggtgctttgttttactggaaataaggtttgagataaggacaagtctcaaattcttttttgtttgctatctactaaagagtgctgtccttggtatctctttctgcaggagcagggaagaggttcctggctactcttaagtagcacaggtagttccataactgaatgaaagtggtgatagtctcaagacagtctggattctgggagaggtttcagcccagttgggttttgttttttttcttttttttttttttcctgctaagagacaaggtcttgctatgttgcccatgctggtctcgaactcttggcctcaaacagtcctcctgccttggcgtcccaaagtgctgagattacaggtgtgagccaccacacccggtccttggctcaggctttgattgctggttaagagcatctttggtgaatctgagccttcccagtgaggaattaccacttcacacatttaagaaggaaagacttaagtaatacctaggtaatgtttttatactttgtctttaatacagtgtggtagcttccatatgggtctatgtatacacattacacactctgtgagtacaaaatcattttttctggaacatgttgagccatacatagttcctttttcatttggtgaaaacagggtattaacttgcctggggttgtatgtgctttcactagcagagcaggcaataaaaacccaaatagttgaactctaatttctcattgcaatctgtgaaaacaagtagaagaaattaagtacctcaacaaggggaacatttgtattctctaccttaaagaagcctgcggacctctctttcaattgccttaaaactctgcagatgaagataacaaagaatcgtgatgagagtgagagtgagaacctgttgacctaagagtttctgtttgatctgtgactcaccttggagcttgattaggtcaattaacagttttgtgcttcaggctgtctcatctgagaaactggactaaatacctttaaagatataaagactaatgtctctagaaaacaaaaagtaggctgggggcagtggctcatgcctataatccccagcacttggggaggccgcggtgggcggatcacttgaggtcaggatttcgagaccagcctggccagcatagtgaaaccccatctctactaacaatacaaaaattagccaggtgtggtggtgggtgcctgtaatcccagctactcaggaggctgaggcaggagaatcacttgaatccaggaggcagaggttgcagtgagccgagatcgcaccactgccctccagcctgggtgacaagagtgagagactccatctcaaaaaaaataaataaataatgacaagaaaaagactaatgtctcttaaatgctttgagctatttgtaaaagttctgtgttttgtaaatacaagttatttcatagatttaatggaagtctttattttttatttttttatttttgagacagggcctcactgtatttttggtagagatgtaatttcaccatgttgccctggctggtctcgaacttctgagctcaagcagtccatctggttcaccctcccaaaatgctgggattataggcatgacccactgcacctggcctctaaagtcttaatgaatgtaatgactaatagacattgttagttttgaaatcacaagagaatgtattttagcacctatctaccaacagtatactgttttattttaaatgggtgtaaaatgtttttaaatgatctggagttgggtgtggtaggttttgctgctttttccagagtgaaaactaaccaagtagaatactaattatgcacttgagtggacattacaacaactaatgctgttgttaccatttactcaatgctaagttttactatgagtagtggtggatagccattaagccttatttgtcaacctctaaaaattaagtttaaaaatcattatgtagtgagtttccttgtttttatgataaatttttttcataatacttttatgacaataactgaggctactttccatcatacctagaataaaatttaaactttacctaccatgggctataaaatcctatatgatctgatccctcatgcttctatcatactggctgcttgtcaggttgtagaatatgccaaattcatggcaagttcttcatccttcaagcttcagctaaaaggtcttgtcagaccttccttatgacctccctttctaaattgggccctaggctgggcacagtggctcatgcctgtaatcccaacattttgggaggctgatgtgggaggatgtgttgaggccagaagtttgagatcatcctgggcagcattgtaagaccctgtctctacaataaatcagtaagtaagtaagctgggtttggtagtgcatgcctgtagtcccagctgtttggcaggctgaggcaggaagatcacttgagcccaggaatccaaggctacagtcagccatgagtgcaccactgcactccagcatggcaacagagcgagaccgtgcctaataaagagacagaaaaagaaagccctttgttcattatcaccaaatccaggtttttctcccccgctttatcttttagactttatattgaattggtcaacaaatcctttagctttactttcaaaacatgtcagaattctgcccctcctctcccatcttcatctctgccaccctggtccaagccaccatcatctctcacccagacgattgcagtatctttctgtcactctgctcccacctttgtcccattcaccctgtataacagcagccggagtgatcctgttaaacctccattggattccttcatttggagtaaaggccaaactcttgacctctttagttaggccctccgcaaactggccatcttggagcccctctgatttgagtcttccccctcccctccctgcccaatacattctgctccaccctcctcagcctccttaatgactcagtcatgcttcctcccaggtgctttgcacttgccttgcctctgcctggagtgctgtttccctgatggatacacatgggtcacttattctgttccttcacacattgattctaatgtggccctggtcacatgttcttaaatttcagcctcccacatccacactcctcctgtacttcttccttgctttatttttttctctttagcatttatcgctatcaagttttattgtgctgtttctcccagtagaatataagctccatgagggcagggatatttttttaatgtgagttccttatggctcctgggcaccatcccagtgcctagaatagtgtctgatattattgagtatatgcatgcatgcatgaatactgtttatcacagtatgtgagtttagttactcatttgtctggcttcctccactaatctgggaatgtcagcaaagcaggacttcattttattcactgttctatagctaatgcttagcatagtgcctggcaacaaaaacattcatttgtgaatcaatgactattaatagtactttgcgtgcgtattgcaacttagtttgtaaagtactcctttatgtattatttcatttgattttcacaatcttatattgataagacagtcatctctctaaacaagaatactaactataggggccttaaagtcaccatattgaaagtgttctggtaaatgatagaactgggcctgagacttacctgcccagagtgcagtgcatttcccactgtatcaaaggactgctccataagatttactatgcaaagaagtatttcaatgacgtatgttacaactagtgtcctttcttatattgttaactaaattttcatttctgggagttgagtataatataaacaaatcctgttttatgggcattatacctaagaatagagagagttgaaaaatgaggtttaaaataaaatatggttctgtgctaaatggaagtatgagctactgacatgtaattacctcaaaaaccacatttctgttttgcttttctagttgctcatcttacagaaggacacgaagagaagtagagtgacctggggcagtgttcttaatgctgatgtatttttccttttcttgacttaataaattttagtccccttaggagtccaggatatatgacaataaactttaacagttgtattcacagcaggcaaattcatgggaactttaaagatttttgaaagctccacctataccttggctcaagggtccattcaaaaaagtagactgtcaggatatgaatacattcattgtactagcaaataggattttagaagtaacactgcggaatgatcattcctgaacaaataactgcatctccataaagtagatgaccatttttcacttcttacaagtatgggtacataagagaatacattacctgctggaggcgtcagtttaactgaattttaagtagaactcgggtttccttctgtgccactccaccttccattgggatgtgacttaaactacatgttcttttttgaaggactgggttatataaattgttgatgtgagatcatttgtattattctaagattcatttgttgtgctagatcttcaacttgctgctgagcttgggaagacattactggatcggaacacagagttggaggactctgttcagcagatgtatacaaccaatcaggagcagttacaggaaattgaggtaattcacttggcaggagagttacacttttgacacttcgatgtgttgctgttatgccaatcacatactggtaaaaaagcacttgcaattagatgcagcattttattttttaacacaaacttttttgagaatgagaaccgcctcccgagtagctgggattacaggcgcctgccaccacgcctggctaatttttgtatttttggtagagatggggtttcactgtgttagccaggctggtctcgaactcctgtcctcagatgatccacctgccttggcctcccaaagtgctgggattacaggcatgggccaccacacccggcctaaaacatgcaatatttaagatatacagaatggggtaagagaacaatacagtgaatacccatatatccaccacctagcttaaaaaagaagactgcccacactcttgaacttcccaccggagagggaacttatacctcctccttggtgacatatccctcccacctactaccaaaccatatcctaaatttgaaaaaaaaaaatcatagttcctgatttcacagtgtgttcagatgttttgctccattcaaataatcataaaatacatgttgctttctctctgctgtgatcttgatttgtttacatttttgctggatattttattaaaatgctacatttttggctgagtgtggtggcttatgcctataatctcagcactttaggatgccgagggagacagattgcccaagctcaggaattcgagaccagcctgggcaacgtggtaaaaccccatctctacaaaaaaaaatacaaaaattaggctggtgtggtggcgtgtgcctgtagtcccagcttacttgggagacagaggtggaagaatcacctgaacctgggaagtcaaggctacagtgagccaagaccgtgccactgtactccaggttaggtgatgggagcgagaccttgtctcaataaaaaaataataataatataataccttttgcccagcttaacaaactaaaatgaaagatgctagactagggcattaaaatggccctctatgctgctaatcttataaatagtccccttcaagtagttcagttatgtgtaggccacttgactgtaaagataatcacggatattaaccagtgtcccatcagaacacctttctccatgtcccaacccatgcttcccccaaaaagggtctgtacttaaattataagctcctcccccttaaattggtacagtagacccaggacttttgtgtctgtgcacagaaaaatgtaaaagactctagaacagtgaagcagttcatcataatgagtacttactaaagctttgattatttcctgaaccaggtgctgggaattcaaacaagcggagaattacacagtccttccttagaagtgatcacatcatacagttttaaacttttgaatacaaatctatcatcaaaacaaaggcaaatgtgcaatctcagtatccattaattttacctagtaacataaaaggtgtatacagtagaccctccccttgagcaggatttctgaaatacacttttataattctaggaaagtatggcttgcaatgatattgaagtcaccaggtaccatttttagcatattctacatcaaaagagcgtacaatatgttttacactaaattgaatttaatgacctactgtaggccgggcgcgatggctcaagcctgtaatcccagcactttgggaggcagaggcaggcagatcacttgaggtcaggagttcgagaccagtctggccaatgtggtgaaactttgtctgtactaaaaatacaaaaaatatggcaagcacccataatcccagctacttgggacactgaggcaggagaatcacttgaacccgggaggtgaaggttgcagtgagctgagattgtgcagttgcactccagcctaggcaacagagcaagactccatctcaaaaaaaaaaaaaaaagacctactgtagagtttgccagaaacctaaaatgcagagaaactaggcatttaaaaactattaaactaggctaggcatggtggctaacgcctataatcccagcactttgggaggccgaagtggaagaattgcttgaggctagggtttgagaccagactgggccacaaagtgagaccgtgtctctagtctaaaaacaaaactattaaactagccaaatgttttacgtggtcaaggaactctttcctactttgtttcgtagactttgttttttaactcagtgggagatttcagaatagtcctaaacgatcatcactgtttgtatttgtgtagagacatagtcttaattgtattatcgtagtctatgaggtttatccgaggcctgattattgctaatagttaataaattgtattgatgtttcctgttagagcatttataaaacactataactggtacttattttagcatatctttcaagtgtagctgaaagaagtgtaaatatttgtaagttgggagaatgatgcctattgattagcataggagattacaaacaactgctttgttttctgtggtatcgaggatgattaaacatttaagctagatcattggtattctgaaagtatccaaagatatctgagattctctaaatctacaaataacactttattatctaatattatccataagatattgcaaagcgtcatggaaatgaaataatccagttcagaccttcatgattaaataggtataaaattcagccgggtgcggtggctcacgcctgtaatcctagcactttggtaggccaaggcgggtggatcacgaggtcaggaaatcgagaccatcctggctaacgtggtgaaaccccgtctctagtaaaaacacaaaaaattagccgggcgtggtggcgggcgcctgtagtcccagctacttgggaggctgaggcaggagattggcgtgaacccgggaggcggagcttgcagtgagccgagatcgtgccactgcactccagcctgggtgacagagcgagactccatctcaaaaaaaaaaaaaaaaaaaaaagtataaaattcatgtataaaactattcaggagatttagcttggaatatttcgggaaacatattcatgagtctcttgttcctgtaatatgtagtccactggttcctagatctgagcattgcacaatgcagtattttactctttatccaaagctgtttttggctaagaataattactctcttaggtttcttcaccaccattacagttgactttcttttttctttccttttataagttgcttcatgaaagtaagtttccagtctcagtaggggagatgagatggcagtaatggctaagcccacttaccagccaggggattcccacagactgtccttgctgcctgctccatcacaactgtgcctgggcagatgtagagatcacgatgtagatttctgaggtctctctaatagcctaaaagaatgccatgtgctcttgtaaaagtaaccaggcagctaaagagcctacttccttgctaaacaatgacccttgcatatgttcctcttattgcaaccttcaggaggccccctaaactttataagggccctctccttaatttgagccttttcaacgtgtttctccttcccttaaactttttattgaaatctacattacagaaaagggcataaatcctaagtgtatagtttgatgaattttcataaagtaaacatgcccatgcaacctattcctagataaggagttgagagcattatcagctcatctggtcaccacccggtgagctagcatcctaagtttagcttgtttttgacctttacgtgaatggaatcacttgtacaagttttaaagtaactgtttagaatgtttattgggaattagattacaaagtaatacacagcttggcgcagtggctcacgcctgtaatcctagcactttgggaggctgaggcggatggatcactgaggtcaggagttcgagaccagcctggccaacatggcgaaaccctgtctctactaaaaatacaaaaagtagctgggcatggtggtgcatccctgtaatcccagctactcgggaggctgaggcaggagaatcccttgaacctgcagggcggaggtcacagtgagccgagatcctgccacttcactccagtctgggcgaaagagtgaaactccgtctcaaaaaaaaaaaaaaaaaaaaaaaaaaaagatcatttttttaattcagaaaaatatatagttgaagaacaaaaagtcagctcctatcccaccaccagtgaaatttaaaatgagacagtccagaagaatggtctgggaacaaactcatctgagcgaatgaaaaatagtgcagagaactggtgaaaatactaggacaagatccctaagattctgacttattatggaaatagacaacttggacactgccaaagggtattttgtaagtagaaccacaaatattctttcaaagactcttggagggtttcaaacaatcctcctaaaaattgatcagtatttttggtaggcatcatttttaatgtaaaaacgaaaaaaacaaaaatttccttttatgtgaaaacgaaaaaagattaaactattcaaaataatggttaaactggcttcagagaagcctgtagcctgtcttactttttttcagtgctaatttgaaaaacttagataattttttaagaatccagagcaagttttttctgttctgggtggaaggaggggaggagagaactcttacttgggagagtaatgagatcagacaccattggattcatttacactttgctacaaccgtgtaagcagcctacagccttgtgttttggttacttccctgcttagacacctgcattatcccctacaggagttgtgcctagcactcaaagtagtctggccttcaaggcatcccttctttcaagagttcatgccctctttggaaatggaaaaatattttgtgctgcttttactgcatgtatcaatattctactgcatatgatacttaattgatttgctttattttcctttccccttatttcccattgcaacagtgagcactgttgtgtttattcatggtctttcacacatactaggtaatcaatactttgttgaaatcagtattttaacagaggagaaacagcttacaaagctcttctaataactcctaaactttgggtttccacctctggagatttttaaggcaggcagaaggggctctggcctctgttttaggagattcaggtttaaaccctcaattttaattgcaaatagctagagaatttagacatatgaattacccctcagattctctttgctccgttatggaatggtgataatgcttacactgctttggtgtaggagttttctgaggggatgagattatggaggcatatatattttgaacagtataaattgttactttggtataggatttttctgaggggatgagattatggaagcatatatattttgaacggtataaatcgttgcatagtttaccaatgttttaagaattttagtagtgagccggtggcggtggctcactcctgtaatcccagcactttgggaggctgaggcaggtagatcacgaggtcaggagttcaagataagcctggccaagatggcgaaaccccatctctgctaaaaatagaaaaattagctgggcgtggtggcgggcgcctgtaatcccagctactcaggaggctgaggcagagaattgcttgaacccgggaggtggaggttgcagtgagccaagattgcgccactgcagtccagcctgagcaaaaaagcgagactccgtctcaaaaaaaaaaagaattttagtagtgaaaaaagtctttaaaaatttgtatggatatataacagctttacatatatctggggcgcctgtgacgttttgatacaagcatacaatgtgtaatgatgaaatctaaactgagataaccatgacctccaacatttatcatttctttgtgttgggaatattgcgtatcttttctagctattttgaagtatacaataagatattgttaactatagtcatgaaagaacttaaattctgaaaaaataaatcttccagaattactggaaatagactttaaaaacaatctaatcccacaattttaataatgggattataggtggtttctattttcatgttcatgcctcccgccaccaaatttctacaggggaaatatatttcatcaggggaaagagatttttcaaaagtaataggaaatatttctttattattgtggaagttcattttgatagtaaattcagaggatttaggctgtaatccttaatttcaggataatcccaacactgcttacaagccagatttccactccatttctatgcatttttacttggggtcgtttgtttctatctttccctgcgttccaggttaggattccacaattgcaaataggtatttatgtaattctgctggcctttgttttttaaagatttaccttaattgtaaaggtggcctgtttgtagcttttgtgcataactggaaccttgtactcatagttgaggtgacagtctgtgcaaattcctagacagtgagataaacccaaggcattttgctataagttgacatttttgcccacatttctgctaccccatgacccccttcccccactgttttgctttaaatgtctccctttcctgtttactatggcagtcagattcattggaggctgtgtatcaaagagaaaaccagcatgtcagcagcatgtctgtaccttgagatgagaggtaggaaataagctaacccatttccttctagattcagaaaaaaaatgaagcactgactccatagacctagatgtctggccttacatcagtacgtacttagagagctcatcatttttctttaagttgctgactggttttgtcagactcttctgtaggtcccctataactgaatcttggagaagtgaagggcttttctgattaattttggttttatataataagattaagctcctaccatgtgaaaacaagctccttgacattctttagattgttgttaaagccaagtcatctaaaaccaaaatatcacaagttcttaaatggtttcattatgttgttatcacaggtatcacaggtttttatatatcaaacaaggaactttctatagtttcttaaatggcctgtttgtacttatttgcatattgacttgtttcctgtatgttggccacaactctaacttgaacatcctatctgtaagagaacaacaacttgagacccatctggtatctggtaggaactgtaaaagtctccccctcagattaccggggcaattgctgccatgggaataaatacagagaaataatctataaatggaaaagcggggagagaattcatggttaataggctgttttcccaagagggctaaagccaaagcccttctcaaaacctttcagttaaatcccccttgacatctcacagtctgagtcatgccaagcacaataagctgttgtgaagaaaagtctagaaactgccagttcgccagtatttttttgtcccctactgtgtgtcaggaatggactagatacacaagagccttccattcttagaagactacagtactggcctggcacggtggctcatgcctgtaatcccttcactttggcaggccgagtcaggtggatctcctgaggtcaggagttcaagaccagcccggccaacatggtgaaacccagtctctaataaaaatacaaaaattagcctggtgtggtggtgcaagcctgtaatcccagctactcaggaggctgaggcagcagaatcacttgaacctgggagaccaagattgcagtgagctgagatcgtgcctccagcctgggcaacagagtgagactccatctcaacaacaacaaaaaattgaatattattgtattgttttgagagaaatcaatttagggtaccttgggaatgctgccgctttagacctgctttaaggtggtcttcttttttttttttttttttcttttttttttttgagatggagtcttgttctgttgctgaggttggagtgcagtggcatgatcttggctcactgcaacttctgcctcgcaggttcaaacaattctcctgcttcagcctccccagtagagtagctgggattacaggcatacactaccttgcctggataatttttgtatttttatttattttattttattttttagacaaagtcttgctcttgtcccccaggctggagtgcagtggcgtgatctcggcccactgcaacctccacctcctgggttcaagtgattctcctgcctcagcctcctgagtagctgggattacaggcacctgccatcatgcccggcgaatttttgtatttttagtagagatggggtttcaccatgttggccaggctggtctcaaactcctgacctcaggtgatccacctgcctcggcctcccaaagtgctgggattataggcatgagccaccacacccagcaaatttttgtatttttagtagagacggggttttgccatgttggccaggctggtctcgaactcctgacctcaagtgatctgcccacctcggcctcccagagtgctgggattacagccatgagccacagcacctggccaaagtggtcttaaaaggcttctgaagaggttatgtttgaaatgaggccagaaggataactggaatttataatctttctttggtgccatggatccctttgattatctaatgagatctaggataatcctcttaaaattcattgaattacaaaggaaacctgttagaatgaaatacctgtcaaatattgaaaaaagtaaatttgtgatgtaatatagatacgtattaacatatttaataacaagatctagaaactaccatgatttcaaatagtgatgaatgtaggcagtaaatcaagatttctgcaactatagtgcaatatgaaaatacctgtgatttctgttgatgatgaagtcacagataaacctaatactactagtggtttattgcctctgtcaaaagaaaaaattacgacaaacatagtataaagatcttaattagcttttatttgagattctaaagttgggcaacacctcattcttagagaatgagggtttcaatgagctgagcagaggaagttggttttatagacaggggctgaggaaagcagaaacagaaaacaaaaaatgggtggtttcaaagttaatttatttgtaaaggttaaagcagagggaagtcccttatgctggctaaaactggcatgtttgggggcttggctattatctcttctaatttctcagaagtcagatgaacaactttgctttggcttgctgacatggaactttagcacaagtgactccattttggtttggtttgttgggcctagggcagggactcagtccaaaccagtggtctcctataaattttaacagatctattagtacttgaaagaaatgtcaaatttcatttagaagttaacaaaaatgaagatgtagctgttcagaccctttaaattcatccatgttcacagaccctctaaagtctatccatggaccccaggctaagaactgctggcttaggtggagcagccaggagaactgcatccccccggataggggatcgtaaaggcattagaggagggaggcacttgccttgcagtggggcaactccaaaaaaggcaaagatatctcccctaagtgtgaaattttaaaaaaatcaatagctaacaaatgaagctggaaaaaccacttgagacaattgggaaaatattaatgctgaaacgtaatagatgttaaggaattattgagtttttttcccttaggaattgtggttaaaataaaacgtcctagaaatgtatgaagatgtatacttgagatgccttggattagctttaaaatgattggaggacgaggaaagtaggagagtagagatgaaataagattggctgtatgttgataattgttgaaactggttgatgggtacgtgggagttcattaaaccatttctctgcatgtatatatgtttgagattatccacaatagaaagttttatttatttatttatttttagacatagtctcactctgtcgcccaggctggagtgcaatggtgtgatcttatctcactgcaacctttgcctcctgggttcaagtgattctcatgcctcagcctcccaagtagctgggactacaggcgtgtgccaccatgcctaactaattttttttttttttttttaagtagagatggagtttcaccatgttggccaggctggtctcgaactcctgtcctcaagtgatccacccgccttggcctcccaaagtgctgggattacaggcatgagccaccacacctggtccacaatagaaagttttaaaatgcagtggataagattagccatctgtagaaattcagtatttgtttggactgagaagttaggaaggatcactcaagcaaggttaaggtaactagtttgtaatttcagggaattaatgattgttaagaacataccaaagtgaagcgttatgatgatgaatgctgctgtggtacagttaaaatataacctaatcttagtggataactgcatctaagctgagccctatgcagggagacggtgagcattaagctgaagagtcatcattgatccagtgaatgcctgtgtctcctagacccaagagaaaaggacattggtcagggcaggggacgtccaggattttccatgtccaagatcaacatttctctaagtgtgatctctggactgcctgtactaatatcacctgggtttgttgctaaaaatgcagaatcctggctctactccagtctcagccgtttgaggggaagggacccaggttcttacactttaataaatcttcttccaggtgaatcttagcacatgtaaagtttgaaaactgtagctttaaataaagatgacagtagcttctccttattgagcaatttaccatctgccagatctcatgctgagctctctacatatattaacgtttttgtaaattatatatttgtatatgtcagggaggaaaaatatttttttcctcaaccttcatgagtgcttagttggaaaggacccctgcaacaaaagacagattaacaagagaaaaacaagcttactaacatatctatttcatttatatgtgtgggagatacccaggggatgagtcattctcagaggtggctttgaattccagcttatgtagtatcttcaacaaagaatggtaattttttagagaagtgacaagacaaaggggaagaactttgtctaggggcagaacttgtgggaaggcaagtaagtggtgataaaggcccgttagcaaagcttgttagtgtggattcctctggtgctgtcttctggcccataaaggtctaaagttgttagtggttaacctttgttctccctggtagagagggaggaggcaggaacctttttatgccaaagacgcatgctttggggtgacatagtccagtctctcccacacacatatttatctttacagccttatgaagtagttgatgaggagaactcacattagaaaaatgtgcttgctgtaggttacccagttctaaacagcaaagcaagacctcaaaccaggttctgactccaaagcctgtgctcttagctactataccactgcctcccatcagactcctctgatcccatgtctaccagagactctcattcatgaatcggcctttcacatgccctttgtggggcagctgtgtcctaatagaggatgtgaatattcttgtcactgggcaggaacagttcctgttgtatattaataaattaatgtctggcttatgcattagcctttttaaaggtagttctgagtcctaaagaatacttgataatttatacttgatataaagaagcttgaaacatttctgcagctattatatatatattcttgtgattctaagccttttttccgctcctgtggaatctcatcaattcctaagagattgaacatgttcccatcaatgacaagaacctactatggaattactagcccgagggcaggattaagggcctactcctttagttctgagaaagcttcacgcatgagaattagtggttgatttccaaaggaccagaagaagctggtgggagttgaggcagtgaagactacacacaggcttttatagaccgtgccatgtgctcacctttctcatttaattctgccagttctacatggtaggtactaacagatccacttactaattccgaactcaaaaagctctataaagcaagattttttttttccccttaaatttgcaacagattcatttggtagtagatctttacctgaactgatgtgaggctgtttatagtcttagttcatactttttgatgcagaaatattaatgcttgattacagggtgctgcccagacctcacaggtattataaggtgtcagctgtgtgtcaggtatgagcgccatgttgtctttctaaaatttaaagaattttccaaaacacttttgacttcaagagtttcagatgagaaagttgaagttaggttaagtgtttgttcaactctttgctgctgagttatgtaaatggatttgaaaaaaaaaaagccatatatgcttttttcaacactttaagggcccgttgagtgtcatttagcccattgtttgttagccttgcaaatccttctagagttgtagaaaaagcctcaagaagagtgtgttgtgttgtgtttgagacagtctctgtcacccaggctgtagtgcagtggcacgatctcggttcactgcaacgttcacctcccacgttcaaaagattctcatgcctcagcctcctgagtacgtgggattacaggcgcgtgccaccacgccggactaatttttgtatttttattagaggtgggtttttgtcatgttggccaggctggtcttgaactcctggcctgccttaagcaatctgcctgttttggcctcccaaagtgttgggattacaggtgtgagccaccatgcctggccaagaagagtgtttttaaagtcaagttctgagtcttttacagtttgatcatcagtaagcttcaaaccatttctcccctctttctggttctgtccagggaaatactgtgactttttcctttggaatatatactgtgttttagtgtcttcaggtagagctgagcagggagggaatcaaggtgacttacactgcggcattaaggttgggattattcccctttatccttggccatttaggaagcagtcttagcaggaccagaataaatcatctgataaatttctcgtgaataaggaggataatggtgataaaactctcataaaattaaaaataacaggagtctttgaagcatattaagctaaaatatatttctcgtcaaagcaacatacttttcattttttttggtccagaatgcctcattcagagaaagagattgatttttttttccaaattaagatcctccacatagaaataggaacgttttacactgttggtgggagtgtaaattagttcaaccattgtggaagacagggtgtcaattcctcaaggatctagaactagaattaccatttgacccagcagtcccattactgggtatgtacccaaagtatcataaatcatgctgctataaagacgcatgcacacgtatgtttattgcggcactattcacaatagcaaagacttggaaccaacccaaatgtccatcagttgatagactggattaagaaaatgtggcacatgtacaccatggaatactatgcagccataaaaaaggatgagttcatgtcctttgcagggacatggatgaagccggaaaccatcattctcagcaaactatcacaaggacagaaaaccaaacactgcatgttctcactcataggtgggaattgaacaacgagatcatttgggcacagggtggggaacatcacacactggggcctgtcggggtggggatagcattaggagaaatacctaatgtaaatgatgagttgatgggtgcagcaaaccaacatgtcacatgtatacctatgtatcaaacctgcacattgtgcacatgtaccctagaacttagagtataattttttttaaaaatcctccacgttaggctttatttctgttaaacatgatgtttttgcttaaactttgatcacatgttccatgttttttgtcttaagggattgttatgtctcactttagattttttagttgaatattaattttatgcatggtatatgctttggaaaattagcctcacaatgcactggggtattggtgagcattagaggagctaagcatataaaggacagcctgtgctcatttcttatgaagacagggagtttaatttcttcttttcttaaaataaacatatggtattgtggtataataaaaattatatatttggtctttgtccctggtttctggcatagaactcctaaaacccttggaatttcctgataggttgaggtctggtcaccagagaaggcaaccacatgattagagggttagatctatcagtcccagccccacaacctctggatagagggaagggttggagcttgagttcagtcaccaatggccaataattgaatcaatcatgctgatgtgagagaagacctggagaaaactgaaatgggtctaaaggagcttctgggcagtgctgggaggccagtgagcccagagatggagactctatgtcagccccaccccaacaagagttggtgctgacaatcggagaattggtgttggaacagcagaacagcaggtatcttttttttttttttgagatggagtttcattcttgttgcccaggctggagtgcaatggcgccatctcggctcattgcaacctctgtcttccaggttcaagcaattttcctgcctcagcctcccaagtagctgggattacaggcgtgtgccaccacacctggctaatttttgtatttttagtggagacggggtttcagcatgttggtcaggctggtctcgaattcctaacctcaggtgatccacacgtcttggcctcccaaagtgctgggattacaggcgtgagccaccgcagccagccaagaaacagcaggtatcttatctgtttgtgtcacctggtcctgatcttctcttacagtatctgacgaagcaagtggaacttctacggcagatgaacgaacaacatgcaaaggtttatgaacaattagacgtcacagcaagggaactggaagaaacaaatcaaaagctagttgctgacagcaaggcctcacagcaaaagattctgaggtaaattttctagaatctgacaaggaaggactagggggaagttctttagtataaactagaatagaacatggctgcagtgggtttgggtcaatatgggataaggtttaatttaattctttttggagaatggagattaaatagacatcctttccaattaagaaagcccagtgtgagtggtttgcacctaatctctcctcaccgcttttgcccttgattcaatatgacaagcagcagtggcttctgtctgttcctcacagcctgactgaaacgattgaatgcctgcaaaccaacattgatcacctccagagccaagtggaggagctgaagtcatctggccaagggagaaggagcccgggaaagtgtgaccaggagaaaccggcacccagctttgcatgtctgaaggagctgtatgacctccgccagtaagagcctgcctttctgtggagttacagcagggactgtctcatgtcattggcacattctgatttccagtagattgaaagtaccattttaagaaaagtcacttagctattaagctaccattggtttgaacaaaatcacttaaacatataaattacagagttcttagatattagtagttctcattttgaaagtcttggaacacttatttcagtgtttttaatgtattaaatcatagtttaagatgaattctgatagactagatttgggagttgtgttttacattagagtgaagaaaaacagaaatactggtaaaacaaaaattcaagcgaacaggagattttttgcttaaagaagtacctttataatttagagttataagtctgaatctttaagaagtatttatggaacacttgtgtggcaagctgtatgctagacccaagggttggcgagcaaaatagtttctacccctgtgagctttcagtctaacggaacggcagataagcaaataaaaacacaaataaatagtcaaggtgcttcagactgagcaggagaaaccaggtggttcatttggtgggtctcaaccttggctgtacatcagatcacctgtggggtttttcaaaatgcaaataccaacacatttcctcaggcctaaatcagaatttctaggtgcgggtaaaaagctgcccaggcaattctgatgaacattcctggttaaaaatcaccacagcaacagtaatttgctgtagtgattcaatcgtagttacatattatgaatcatttggagagcctttagaaaccctcaggccaggtagcagaccaactaggttggaatctgtgggttgggacccaggcaccagtactttttaaggtttcccttgtgaggtcattgtcatactgctagaatagatgttctctagtacttttaacattaaaaaaagatttgtcacaaaaattgagtttgctttcatgtgtttatttaccagcctcacacaattccattttagccactgctccaagtgtggctaaaaaccaatcactgttggccgggtgtggtggcttacgtctgtaatcccagcactttgggaggctaaggcaggaggatcacctgaggttgggagttcgagaccagcctgaccaacatggagaaaccccgtctctactaaaaatacaaaattagctgggcgtggtggcgcatgtctaaaatcccagttactcgggaggctgaggcaggagaatcgcttgaacctgggaggctgaggttgcaatgagctgagatcgcttcactgcactccagcctggcgacaaagtgagactccgtctcaaaaaaaaagaaaaaaaaattagtcactgtcacagctcctcaaatttatttagttgaaaaaaaatcaccagtcttcctctcgtcattttcagtggacctgtgtaatatattctttcaatatttttttccctagacacttcgtgtatgatcatgtgttcgctgagaagatcacttccttgcaaggtcagccaagccctgatgaagaggaaaatgagcacttgaaaaaaacagtgacaatgttgcaggcccagctgagcctggagcggcagaagcgggtgactatggaggaggaatatgggctcgtgttaaaggagaacagtgaactggagcagcagctgggggccacaggtgcctaccgagcacgggcgctggaactagaggccgaggtggcagagatgcgacagatgttgcagtcagagcatccatttgtgaatggagttgagaagctggtgccagactctctgtatgttcctttcaaagagcccagccagagcctgctggaagagatgttcctgactgtgccggaatcacatagaaagcctctcaagcgcagcagcagtgagacgatcctcagcagcttggcagggagtgacatcgtgaagggccacgaggagacctgcatcaggagggccaaggctgtgaaacagaggggcatctcccttctgcacgaagtggacacgcagtacagcgccctgaaggtgaagtatgaagagttgctgaagaagtgccaagaggaacaggactccctgtcacacaaggctgtgcagacctccagggctgcagccaaggacctgactggagtgaacgcccagtctgagcctgttgccagcggctgggaactggcctctgtcaacccagagcccgtgagttcccctacaacacctccagaatacaaagcgttgtttaaggagatctttagttgcatcaagaaaactaagcaggaaatagatgaacagagaacaaaataccgatcactctcctctcattcttaattgaacctctagctctactactaatttgcctattgcctatcgcctctctctcccattcagacaagtgtttgtagactctgaagcctaatgttactcatgacgtttgcctcattgctttgcttatttagcaaatgcatacaacgaggaaaggaggtggctagtggtatcagttctctgatccacttccatttaagctccccaggaaatcccatgacaaactggcctctggctggcgcgctgattagacttcagttcctgaaaaggaccagtggagggaagagctatacttctggagaagtaggcctggagttactacagtatgggggaaaagggtcgagttagaacaaagctaaggcaattcctattgcttccttgcgcaacttctcaaaacgatgaaagtcagaaggctgtcaaactcaaatatctttgcaaacagtttgaatactgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaa

SEQ ID NO: 37261 - DNA, 29263 bp, Homo sapiens
tctcccaaaacaccggtatcaatttatgctatatttacataaccaaagtagccattcaagtaactcctcaataaagttctgctccctggagccttgctgtctctgctcaaatgtgtaggctattgtttaagtccccccagcagcccttcctcccctcctacccttttgtaggaaacaggacctgcccattggctagaagataagcacatgacagactgggcaaggtggctcacacttgtaatctcagcactttgggaggcaaaggtgggtggattacttgaggtcaggagtttgagaccagtctggccaacatggtgaaaccccgtctctactaaaaatacaaaaattagcttggcatgttggcacacatctgtcatcccagctactcgggaggctgaggcaggagaattgcttgaacctgggaggcggaggttgcagtgagctgggattgcgctattgcactccagccagggtgacagagcaagactccatctcaaaaataacaacaacaaacaaacagaagataagcacatgacagaagctgggccaatcagtatccttctgtgggattttttttctcctagggctggtaggtaggagagaatgaagcagacacaggaagaccaggggcagagagagagaacatactttttgcttaagcgagacccaacttcctgtgtgtacaaccaaaagccctgcttgatacaggctgtttctgagagttcctcctgatcaggcatatttatctataaagagttgggatttgtgccatgttatgacctgaagactagagttcatgtctaaattattcatacccctacttttaaagcataaaactaaaaacataatctcaaacatgcttgctgttatcaccagtcattgatgtggaatgggttgcttgggtggcacatggagttttttgcactgtgtaaaagggccatgcatgggcacagtggctcatgcctgtaatcccagcattttgggaggccaaggcaggaggactgcttgagcctaggagtttgagaccaacctgggcaaaatagtaaaacttcatctctacaaaaaaaaaaaaaaagtttaaataaaagattagccaggcatggtggcacatgcctatattcccagctacttgggaggcagaggtgggaggatcacttgagtctgggaggtgaaggctgcagtgagccatgattgtaccactacactccaacctgggtggcagagcaagaccttgtctcagaaaaaaaagtaaaataaaataaaagggccatggcttaatagattgcaagcgactgccttgcacagtccaatcttggggataatctgtctgaggacaccagggccatgagtccctccaacccatgcaacctatttaaccagtgtattagcaaatgtcaatggcagacccagatacagggatgagctgggaaatccaacaaagctgacatatctaggacatagaaggaagctggtgcagccaggatacccagaagtgagatcaacaacagcgggagaggtggggcctttggatcccttcaaaaggcttccccaaggagacacagctgtggatgatgagtctgagtgggtaggggtcctaccaccaccccctctaaactctcagctgttgctcctccctttacaactgcaaccccagtactaaccccatgcctggtacatggaagcatttggttaaactaatgagtaagtcaacagtcctcacttaattcctagatgggccacattgctgagaagcagcacacaagccatccatgaagaatgttcccttcttgggaaattcacaggcacccaagttcacttactgctggggcaggtttgagagcccaaggagtgttttgagggttgagcagtcacaggctcttgcaggcagagtttggggtttcattgatagcactattccttcaaaaatgtcataggcctttaatccattttgttctggtcagttccaacgtgaataattgtagccaaaaatcttatctagacatggtttccaagcctgaaaactctgatcttttacttaccagccattccccaaacttaatgatggttttcttcaagccatctgaaacaaccggcttgagtgggaaagcaccatccttaattccttctttgccaacaggctcacagcttttctaaagagggcaccagtcttaattcctgctaaggctaccactttgcagttaccacttataactgcttcggtgcagaagcaatggctttttcaagtctgcagaactcaaaattacaggattctcaatcaacccagattataggttatagcaaagacttcctcccttggcaaagctatgcaaagaagctaactctagcttgattttctctctcacaggacttgctaaaagtagcaagaagaagccagaaaacaggaacattctgaatttccgtatcatttattttttatttttttcttgagacagagtctcactcttgttgcccaggctggagtgcagtggcgcaatctccgctcactgcaacctccgcctcctgggttcaagcaattcctcagcctctggaatagctgggattacaggcacgtgccaccacacctggctaatttttgtatttttagtagagatggggtttcaccattttggtcaggctggtctcgaactcctgacctcaggtgatccaccatccttggcctctcaaagtgctgggattacagatgtgagccactgcacccggccctgaatttccttatcatttctacatggctgcattgcattgctacaacctcagtcagtccatgatctgccttccaaggtgaggtagctattgtctgaagattgtccctagagagccatgtcaccagtattcacagccttgtgtagtatcctccctttacatctgggctgggcctgtgactcactctaaccaatagactgtggcagagtgacacttgccggttctaggcctaagccttaagaaggtcttccactttcgcattcttgggatccagccgccatgttatgatgcccaggctaagccacgtggaaggagaggtcacagcttttggccatcctggtgccacacatgtgacaccaaggaggtgtcaacttgcatattcatccccagcttcaatctgactgtaacctcatgaaatacccctgtgagatccagaagaaccacccagctgtcaccgtcaacccacagaatggtgagaggtaataaaacacttgttgttctaacctattaagtttggaggtggtttgccacacaataatagttaactgaaacacaaggttttgatcaaatgtttgaccactgcataacaaggatcacaagcttcccagtcagcaatgtctgagtctttgccatctgccacccacctgcattcattaattaagcatttaggttctgtcacttgtagtagtctttttccaggtgccaaattttatatcaattagaatcagctttgcctgtgattgacagaaaaaataaagtaatagtggcttaaactaaataaacgtttatttctctctctcataaatgaagtccagagataagtcctgtgtctcttccacagtttcagggacccaggctccttctgtcttgttgttcttccaccatcaacatatagcttttctctcccagtccaagatggctgctccaattccagccaaaatggctgctttccaaccaacagaaggtgaaagagacaaagaaagatgtctctctccctctaaggacattttctgaagttgcacaggacacttctgccagtatttcatttgccagaatttactcacatagccacactaagttcaaagataggctaggagatgtggtctttattccaagtggctatgtacccagatgtagatctagggttctaaggaagaatgaatactgaggatagactagcagtctctgctgtcaattgctctgattacactggttttctgatcaatcctgatttctggagaacaggtctcctcctctgttcttatttttcatacttttgacaattctttttttaaaaagaaatttattaatattctagctggaactacatgaaatttatatagtaattttaaagagtttttatgaatttatatcttttcatacaaaaacatgatgtgtcttttcgttcattcaaatcttgttttatgtcttttaataagattttgcggttttcttttttttttttttttttttttttgagacggagtctcgctctttcgcccagccagactgcagtggcgctatctcggctcactgcaagctccgcctctcgggttcaagccattctcctgtctcagccttccgagtagctgggactacaggcacccgccaccacgcccagctaattttttgtatttttagtagacatggggtttcaccgttttagccaggatggtctcgatctcctgatcttgtgatccgcctgcctcagcctcccaaagtgctgggattacaggcgtgagccaccgcgcctagccgcggttttctttttatgggttcaatactcttctaaagaaaatgtattctgaagtatttcatagttttggtttctatcataagtataatccccaccaccattttgtttcctggtattcattttaagagtaaaaagagactgacacttttgcttccaagtataatacagcagcctttggcattgagtgctcctgctgagaacgacaagaaacgccagataaaatagcctctcacaagaaccccacaccttgtcccaaaccaaatatataaaggcaatgaagatctgctgaaccaaccaggcctagggggccagtgttccagaggagggaatggagggaaggggagctaacagtctgcagctgctttttattcctcattgtaaagttttctttaaaaacaaacaaacaaacaaacaaaacaggtttttcgctttttttttttttttttttttttttgagacagagtttcactcttgtcgcccaggctggagtgcaatggcacgatcttggctcacagcaacctccacctcccaggttcaagcaattctcaattctcttgtctcagcctcccaagtagctggggttacaggtgcctgccaccactcccagctattttttttttttttttagacggagtctcactctgtcacccaggctggagtgtaatggcacaatctcggctcactgcaacctccacctcctggtttcaagcaattctcctgcttcggccttccaagtagttgggactacagacacgtgccaccatgcccagctaaatttttgtatttttagtagagatggggtttcatcgtgttagccaggatggtctcgatctcctgaccttgtgatccacctgcctcagcctcccaaagttctgggattacagatgtgagccactatgcccagccctaatttttgtatttttagtagagacggggtttcaccatgctggccaggctggtcttgaactcctgacctcaggtgatctacccacctcagcctcccaaagtgctgggattacaaccgtgaaccaccgcacccagccggttttttgctttatatatttatcttatatgcagtcaccttgcccaattcttttattaattctagcagtttttactagaatctcttctgtttactagacatattatttctagcagtaaaaagaattttattttatttttttaagtttatagcagctattttattttcttattttcgtattttgagatctggctcaacctgggtaaaataaccaaacatttgaccaatagaaagagttgctgatgtcttggataatggaataaagaagttcactaaaaggtagtgaagcccttacctgctgggctctgtgtcatcctcctaatcctcccaacactcacatgaggagggcagtgctctctccacctacagaagaggaaaggagacttagaagcgttcagcaatttgttcaaatctcatagtgggggtggcaagagtgggtgtggggggtggggcaagagggagagaggaacccaggccagagttgccaccacctcgtcttctctccaccgtcctacactgagttctgaaaggagttttaagttttcctaaaagaattatctgtcaattcaacaaagtattatatgtgaatcttcatagatgacaaatgatggcttcattcactccctcattcatttgttcttttttttttcttttctttttttctgagatggagtctcactctgtcgcccaggctggagtgcagtggcggggtctcggctcactgcaacctccaccacgaatctgtaccatggacaaacctagaagatgctgcagcagagttcttttttttttttttttctaatgagacagtctcacttactctgttgcccaggctggagtgcaatggtgcgatctcggcttgctgcaacctctgcctcccaggctcaagcaattctcctacctcagcctcctgagtagtctcctgagtagctgggattacaggcatgcaccaccacgcccagctaatttttgtatttttagtagagacgaggtttcatcatgttggccaggctggtctcaaactccttacctcaagtgatccacctgcctcagcctcccaaagtgctaggattacaggcatgagccaccacccctggcccactgcaacaaaattctatggagaagtatctgacaatgtaagactaagatttactctcctggggaattaatgggagagagttaatgtgtgttgtgatactacatgtgttaatagtaatcttggtttggggcagaatttttctgtttgtttgtttatttatttattttgagacaagatctcttttgctcaggttggagtacagtggcgctctcatagctcactgctcccttgaactcctgggctcaagcaatcctcctgccttagccttcccagtagctaggactataggtgcataccaccatgcctggcctaaagataaaagatgtgatagcttcccttggagaagagaacatgggtaataacttagaatctgcaggtgaagagagtatttatgaccagacaagaggagccaggaagaaattaatgttgaaaagtcaagtgtacatttaaacatcccagatgggagaaaaatcaattctacatcaacattgctaaagaagaaaacagaaaagccaagacagatcaggtgaaaaatcttcaggctgagcaaacctcgactgaaagtgcagatcaaaatcttctgcagagaggaaatgaagtgactgaactttgtcaagacaaagcagtgtcgtctcttgagaaatgatctgtctgggaaggtcattattggagcaagaggaagaaagttctgaagcaaatgccaagatgagcctgttataaagagctgaagaccttcagaaagcaagtcaaagaccttgtagcacagtgcaacaggatcatttgttcttctcaaaaccaagttatttcccttgaactaaaagctcatgattgttagttgagagtacaggaggctgaaagaaagctcctcatctcaaaactagagatcacaaagatgagataaagaataaagaggctgggcatggtggctcacacctgtaatcccagcactttgggaggccgaggtgggtggatcacctgaggtcaggagttcaagaccagcctggccaaaatggcaaaaccctgtctctattgaaaatacaaaaattagccaggtgtggtggtgcgcacctgcagtctcagctactgaggaggctgaggcacgagactcacttgaacccaggaggcagaggttgcagtgagccgagatcgcgccgttgcattccagcctgggaaacaaagcaagacactgtctcaaaaaaacaaaaaccaaagaataaagaaaacagtgattaaacttgagcttctagaagtccttattcatctgatgatccagatggagtattgttcaggtaacattttcaccacctcccatctctagacatggggtaccgtttcctctagacgggaggctctcaacaccctcccctcagatctccttgtctgccaggccttcctccttcattcccaaacctggtgtttccaattgattcaaattgggagttaatggaaggaagacatcctcttcttccctgcattagtcagggctctccggagcaacagaaatagtaggagatatatacatatacaaagagatttattttaagggattggcttatatgattgagggggctggcaagtctaaaatctgcagagcaagctggaaactctcaggctggggctgaggctacagttcaatccacaggcagaatttcttccttctcagggaaacctgttttgcttgttagacccttcaactgattggtgaggcccaccaattatcaaagataatttcctttacttaacttcaaatgattgtataggtcaaccaaatctacacaatatttttacagcaacacctagattagtgtgttagattgagtaactggggactatagcctagccaggttgacacataaaactaaccattacacttcctggctggagtgcagtggtgcattccatctcctgagctcaagcgatcctaccacctcagcctccttcgtagctgggaccacaggtgcataccaccacgccctagccttaaaaaaaattagaaaaatattttattagttttaaaaactttttacatctcaacaacaaaagccaaataacccaattaaaaaatggacaaaagattagaataaacatttccccaaagaaggtatacaaatgtctaataagcacatgaaaagataaccaacattgccaggcgcggtggctcacgcctgtaatcccagcactttgggaggccgaggtgggcggatcacaaggttaggagttcgagaccatcctggctaacatggtgaaaccccatctctattaaaaaatacaaaaaattagccgggcgcgatggcgggcgcctgtagtcccaactactcaggaggctgaggcaggagaatggcgtgaacccaggaggcggagcttgcagtgagctgagatcgcaccactgcacttcagcctgggctgaacagagcgagactccgtctcaaaaaaaaaaaaaacaagataaccaacatcattcgtcattagggtaatgcaaataaaaaacacaaggagtgaatacttaagacagacaataacaagtgttggctaggacatagaaatatcggaactcttagaggttgttgatgggcgtgtaaaatggtgcaatcactttgaaaataatttgacagttcctcagaatgttaaacgtagagttaccacatgacccagaaatttcacacccaagagaaaataaagcatatatatgtccacacaaaaatgtgtacacaaatgttcacagcagtattataatagctaaagagtagaaatcacccaaatatctatcaaccaatgaatagataaataaaacacgatatatccataaaatagaatattattcatcagtaagaaggaatgggccaggcgcagtggctcaggcctgtaatcctagcagtttgggaagctgaggaaggagggctgcttgagcctaggagatggagacaagcctgggcaacatagcgagactcggtctctgccaaaaatacaaaaattagccaggtgtgatagcatgtgcctgtagtcccagctacttgggaggctgaggtgggaggattgcttgagccagagaggttgaggctacagtgagatcgcaccattgcactccagcctgggtgacagagtaagaccttgtctgaaaacaaaaacaaaaacaaaaacaaaaaacaaggaatgaaatactgataacatgctacaacctggataaactttgaaaacattatgctaagtgaaagaagccagtcacaaagggtcacacattgcatgattccatttattttttaaaactatttatttatttagaaacaaggtctcactctgtcactgagtctggagtacagcagtgcagtaacagctcactataacctcaaactcctggcctcaagagatcctcctgccttcacctcccaaatcactgggattataggtgtgagccaactgcgcctggcccatgattccatttatatgaaatggccagaataggcaaatctgtacagaaagaaagcagattaattttgccagggacttggggggaagacagattgggagtaactgctaaagactatagggtttcttttcttttctttttttttttttttttgagatggagactcgctctgtagccaggctggagtgcaatggtgtgatctcggctcactgtaacctctgcttctcgggttcaagtgattctcctgcctcagcctcctgagtagctgggattacaggtgcgcgccaccacgcccagctaatttttgcatttttagtagagacagggtctcaccatgttggacaggctggtctcgaactcctgacctcaggtgatccgccacccttggcctcccaaagtgctggaattacaggcgtgaactaccatgtctggcctagggtttctttttagggtgataaaaatgttctgaaggccaggtgcggtggctcacacctgtaatcccagcactttgggaggccgaggcgggcagatcacgagctcaagagatcgagaccatcctggccaacatggtgaaactccatctctaaaaatacaaaaattagctgggcatggtggtgcacgcttgtagtcctagctactcgggaggctgaggcaggagaatcacttgaacctgtgaggcggaggttgcagtgagccgagatcacaccactgcactccagcctggtgacagggcaagactccatcaaaaaaaaaaaaaaaaatacccactgaattttttactttaaaagggtgaattttatggtaggtgaattacatctcactaaaattatcactttggccgggcgcagtggctcacgcctgtaatcccgctctcagggaggcaagaggcgggaggatagcttgagcccaggagttcgagacctgcctgggcaatatggcgagaccccgttctccagaaaaaggaaaaaaaaaaaaagacaaaaaaaagcgtaaaattatcactttaaagtgttttcttttctttttttttttttttttttttgagacggagtttagctcttgttgtccaggttggagtgcagtggtgaaatctcggctcaccacaatctctgcctcccggttcaagcaattctcccgcctcagcctccctagtagctgggattacaggcatgtgccaccacacccagctaattttgtatttttagtagagatggggtttctccatattggtcaggctggtctcgaactcccgatctcaggtgatctgcccgccttggcctcccaaagtgctgggattacaggcatgagccacagcgcccggccatttaaaatgttttcataagcacttttacttttgctcaaattgcatcttgatataaacttcaagttttttaaaataaagataatataaattattctcattatattatactctctagaaaatgtaagtagtaaatttgaatttgatgagccagtccactatttcctaaacaatgtattatctgtgggctgttcattcaccagggacacttgaaatggcaaaatcttttcctctctgccaatggttctgtgcaccatagccacaaagaaatgtaaaagttacttgttggcttattagtctcaataagttttagttgattgaacaaacaaagtctctcacagccaggactgctgcggctggaattcctgacatactgtcatacctctcactcgtcaatctacactctcctcccatctacacagctctggaaattaaaaacaatccaaccatgactatcatggcttcagaggtctatgaactcccaggaattatacgcagattttttcctgaggacagtctacacttccttattggcttctcaaagagggtcactgaccagcttttagagacatgggccaagtccggctacgtttagattcggtagtagtgtctgtggttttagtttgccacgtcctttcctctttttttcgtcatagtgcccgctctttgggaggtaggggagagtcttcccctgaagtctccactgctgctggagaaccttcctttttcatctggttgctaaatccagagaatgaaatctaggagatgattgcaccgtccccgcccctcaacatgaaggatgccccactgcccatcggggaggggagcagggagagctggagagaggctgggtcggggcaggacccaggcgcagatcctccgaggccagctgcagccctacctacctgccttcccgtctttcccctcccttcttttctccttctgtctttccttccttccatatctctttccttgcctctttccccctcccactgcttcctttcttccttccactgtggaggtggaaaatttagctaggagaagctgggactgggacgttccaggaaccagacagagagtgagttaaaggcacagagatgaaaacgcggtatgggagagctggttcttgagtcggctaagaggggatgaactcaatggttaataggattggccatggcgaatccctcagcagggcacgcaccgcacaaagggccgaggagcgagggtagctcgaggtcaggattacagagactcaggagcaagagaggaaggcttaaagagccagactgcgcagccaggactggggtgatgggcgctgtcctgccaggccaaagaatgaagatgtagccccgcccccaacctagggaggaggaccagcccggttcctgtcctgcccccgcaacctcgccccgattccactccgggaacctcggcgatgctgagccaagaccacttctgaatcagggatgacttgtctagtgaacctagggtcagagccatcagttggaaaggctgggaggagcctggagaaagagggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtaaggaagagttctctgggacaggaggaagggcccagggcagggtgggcacccttgccacataggggacgggacagaagtcttttaggccctgacatcctctggtctctgaatgacatcctgtggctgctggtaggtgagggtttgcggggctgagctattgaaggaaatgatcacagtccgaggtgatagatacagaaagtcttcctttctccaggtgggctcccgccagtccattcttcactgtgccctagaggggcctttccgaccccctaatcacacacctcactcctcatcttgaaactcccacccccagctccagtcactgcgtcctaacatccaagctctccgcctgtcatgcaaggcctctgtgctatttctttccaaaccctgcagctctatcgcctgacactcccgatgccctccccacccctgcgctttatgttctagacacacggaaatgctgggcactcttcaacatcctgacagtattcataggggaaatttcgggtcgcctaggaaactgcccctcatcctccaaggcccctttcagcctcctctgggaagccttcctgaaccccttgagaaaagtcaggctcatcttttccattgttaaatcacaccttgtgctccaattgtgtgtttccatgtaatctccctcactagactggaagctggggatggaaaggggaagcatcaaaaaaacatgcaaaactaggagcttggcttctccttgcaactttactttttctttttttctaggaactgagttcaatgattcttaagaaaaagtatttcatgataaatgagtgaacaaatgtcttaatagaaaagtaaaattgcaggcggggctgcttctgcccagctctacaggggtagactacaagtcccagtacgcctcgggtcagcatctcttcacgtcactccccctccctggggtgggcaggtccggagggcggggcccgggggcagctgggctctcaggcgctgcgggaggagagaaatgccccaggctctccggggcacacaaagcgcaggcgcagcgggttgggtggcagcagcatcgagtagcggccgcttaggcagcaacatccgcaacaagtgtagacaaggtgggtgcatcaaggggaggggctggaaaaggagtctgcacctgaccctcttgtctgatctgtgtcaagaccgtggagaggggagggagcggcaagaggaacagacaaggctgggccttccagcccaggtgtgccagcccttgttacgcagcaacaggtgtgagcaggtgggggaggggcggaggcacccgctggcaagtgagtcgccctcaggaacagagggcacctacctggattccagtgcaagctacatcatgtacatggatgagtcatttgctaaccctcagtttgtccatctgtaaaacaggagtaaggattcccttcctaacagggttagagtggggacaaggtgagggagtagaatgtgcggtgacgtccaaacttagctgtacattggaatcatctgaggatctttgaagagtatcagggcttgcctcctgccctcagacattctgatttaattgttacggagtgtggcctggtatcggaagttctcaaagctcctgccggcataacggtttgaagccaggactgctgggtgtgagtctgggctccattgcttactaatcaagtggccccgtgcaactgactggacctttccggcccccgtttccccatctctgaaataggaataataaggactgcagggaggcttaaatgagataatggatgaaagcactgatagggggtacccggacagagtgctcggtccatcacagctgctgttgaactgctctttgaagcactttgtaaacagctctagtggggtccaaataggagggagcttttccctcatccattgccgtgattctaatattctgcacttccacattacagaatcccaaggtttctaatactttaagagtctcatgctccaccgactgagctagtcaggcatattctaatgtttcaagagctcctccctccagcctctgcctgcctcacagacacacttctacagatctagaaactgagaccaggacagagggccagggaggagggatatggccaaagttaccaagctgaggctggaatccaggctcctggtccccacccccaccccacaccaatggctgccctgctgaccccacagtgacagtgctcccattctcttcctgagcagagaatggggaggaggccgaggccgcctggcccttgtttactaaccctccctcaaacgtttcctgggtggctccccagggacggcagggctgggggcttctctccagggagctgctgctgaggcctgtgtctcccgtggctcctctgacaggtcccgcctgactccgctctggaaagtccttttgaagaaatggccctggtgaggggcggctggctgtggagacagagtgagtgatcctgggcccctggtcctggggcagggtgaaggaagtggcttactgggcttgccacggggaacacttctctcaagaaaccaggaccttttcatccttcccttgtttgtccatgctcttccctctgcctgaaggtccttcccattcccgactacatggtttaaacttctatttgttcatcacgacccatctcagatgggcccctctctgaggagccttctctggcttttcctctggcccccacccctgctcctgcagtagcgtcaagctggattagaggctccctcctcggttttcacggcgccttacagtgatctccttagaacagaactgtctatctgtgggtatccccactccctgaccccagactggccccagtctgcgaactcctcaaggacaggggctgggtttgaccctctgtgtgtccacagtcccccaaccccgggctggacacagaacgaggcacagaacaaagtgaaaaatgcctttgtgctttggaatccacaaagccctaagaagctctcttatgtctttgcccttccctgttaagatttccagttgcaaaatgtcagaagctcggtctcgggcttctagacccacctctgaccagagtcatgacctgagcaagagctatcctggggacccctgggacaagcagccccatgccccatacccctgcccattctcagttcatttagttcagcaaacactgagccaggtctccctgggtgccaggacctgcgtggggagccatagcccccagagtggtacaggaggcagatgctacacaaataaccatcacacaagtcagagatgagagataagaggccgggcacagtggctcatgcctgtaatcccaacactttaggaggctgagttgggaggattgcttgagcccaggagtttgataccagcctagacaacatggtgagacccactgtctccaagaatacctacctggctaattaaaaattagccaggtgcagtggtgcgtgcctgatgttccagctatttgggaggctgagatgggaggatcacttgagcccaggaggttaaggctgcagtgagccatgcctgtgcccctgcactccagcctgagtgacagagcaagaccctgtctcaaagacagagagagagaagatgcaggcttaaggtagggagaggtctttgcccttgaagagacctggggcttggccttagaagcttccaagtaatgggcccagtcactcatttccctgttcagcacgtgtatcgagcttctgctatgcatcagacccaatgggaggcaggaggtgaacaagacagaaagaggtcctgccctcatttcagggggtagacaagaaaaaggtggttgtaacactagggactgaggctgaggggacttgggagtctgtctggggcttctattcccagcaggctctgggatcagcctgcctagtgcatctggaatatcgtacaggctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatggtgagcagaagccccttcctctgtggcaccgtgactgtgggcagagcctcccgctgtctccgagaacacttgctgttggaagtctttttgcagctttcagaggcatttcacagacattgcttctgagcctctgtcaactccaattcagtttggtgtgagttaagaaataggtccttggctgtgtgtggtggcgcatgcctgtaatttcagcactttgggtggctgaagcgggcggatcacttgaggtcaggagttctagatcagcccggccaacatagcgagaccctgtctcttaaaaaaaaaaaaattggtgagatgcggtcacatatggctactggggaggccgaggcaggagaattgcttgagcccaggaattcaaggctgcagtaagctatgatcccagtactttgagaggcatgtagattacttgagtctagagttcaagaccagcctgggcaacatggcaaaaccccgtctctaccaaaacaaaaacaaacaaaaattagccgggcatggtagtgtgtacctgtagtcccagctacttaagaggctcaggtgggaggattgcttgagcctgggaggcagaggttgcagtgagtgttcatggcactgcactacagcctgggggacagagctagaccctgtctcaaaaaaaaaaaaaaaaagaaaaagaaaaatcagtcctttagtgcctttctcctctgtgctgtctcagaggtgagccaggcacagttcctgccctccaggcgctcggtactggatgaagacgaaatgaaattaggaggcccagagaagcgaagtggcccagagtcacagcaaatctccacattcctccaccaaggcccaggccacagttctaacagggtaactgggaggtgtgctgagggaagcctcagcatggaaaggttggaaaggttggaaacgtagagtggaatccctcagagagtatatgggatcagaggaggttggcagtggccagtaaacagagcccagagaagtcaattcctattcctgtccctgctttactggggggacctggggcttgtgcctgtggaaacccatatatgtgtgtctgcttccagatgtgcagcccccagagggccggagccgagatggcctgctgactgtgaacctacgggaaggcggccgcctgcacctctgtgcggagaccaaggatgatgccctgtgagtcactcccaggagaggatggggtggaatctcggggaaagttaccatgtgcccccttctcattgggccttctggttctctgaccgtaggaagagggcactaaggccagtcagcaagggagtcttattggaggcgggtggagtggatttgaagggcttgtggtgactggcatggcacacagtgaactcctcatgtggtctacagtgaactcaggattgctgagggggaggtgtgcacacctgcctcaggtatctggttcctggtctttagcggcctctgaggtgagccctcacctgagggtgatgcaaagcagcagagcagcctagtggcacccttgctcccttcttagaagatgccctggtgggggactctgatctgaggggtagccctggacctgcctacaaaggcagtcagctgcgtcccaggcaggggcaccccaatgtcagatgcatatccacgtggccagcctgggtgtgtccttctcaggcaccatctgctggctcacattccgtcccttcctaccctctggctaaggggtacatggcctttgcgctggaggagagtgaaagagatgggtgtgtgggagtgggggaagctgagctccaggcagacagcacagagccgccttgtccaacccagccaggtgccatggcaaccaacaaaggccccattgtcccgtgtctgctgggccttcctgaggctctggggtcagagctttggggaagtgttttgtttgtagatttgggatgtggagggggactgggctacaacacccacccaagagtgtcagaatctgacatcccctgagagaccacccaagcccaaccgtccactgtatagatgaggaaactggaacttctagaggggacgagaagaatgaattagcctaacttagtgctccatccatgtgactggggcaggggaggggtcacttttgtcttcctgagggagacaagagatctctcctttcatgagagacttgggcttgaggctgggttggagaggaaagtctaaaatgtgggggcccaattcacccacccccaaactccctcctcatggtctggtgggatttgctttgcagagcatggaagacagcactgctggaggcaaactccaccccggtgagtctcccgttctctccccctttccccaccacctccatgtgccatggaatcatgagtgactcagactcggtctccacctgccagaagttctcagtcttatgtggataggtttctgcaaactctgatgcctgagtcccaagtgttcggggaaaggataagggagagccaactggtgctcagaggagagagagaagcctccatggagatttgctggagggagtggcacatgagctggggagaaggaactgtcttttatcgagcaactattatgtgccaggtgtggtgcaggtatcattccagctgctcctcacaacagtcctgtgaagttggggttattgttctctctctgcagatgataagactgaagctcattcatccgcacaacaaatatttactgagctgctactatgggccaggtggtgtgccaagtgccagggatcagaggtgaaccaaggagatatgggctctgcccacctggactcagcctaatgagaagccagacatggaacaactaattaattattccatttcaatagtaataacagctctgacagagatttgcagtgtctggccctttcatccaggtggtagttcaggcaaggcttaaaccgaggactgaaggataaacagaaattgactgggtgaaaggtgtggggatcgggtaaagggcacggcattccaggcagagggatcagcatgtgccaaggctctgagagaggttaagacatttggcaagttgaggaacagaaggacagctggggtggctggtgcttagggagtgagtgggtaaggagggaaggagggttggcacgaccaggtcttgtgggctgtatgaaggatgttggtttctgctaagagcaccagggagccatgacaagtttttgaacagagggatggcatgatcagatcaggttcaatttatatttttaaaaagataattgttgtaacgttggggcatgtaaaaaaaagggggtagtctgtcagtttatgaaattttgttgtagaaaaaaggaaaaaaaaaaagatagtctggctggtaggtagggaatggattatagagggtaactgcagacacccagaggccacttaggaggctgggacagtgtccgggcaacagactggagatctggattaaggccttgttggccgagacaggctgatgagtacaggacatatttaggagatggagtcaacagagcttgtgactgatggaagtggcggtttgaagagccgcccaaagcccagcttggcctccacccccatctgcctgactccagaatctgtgcttgctctttctctgtatggcacaatggagccccctctcacctatagagaaagtccgttgggaagtagcaggggagacctggatgcatttagaaacctcctcaggcatccacgtcctgagtgccaggcatcatgctaagcccctggcagcagtgacatcatttcatcttccaacaaccctggcagggcagctgggtgggggttggtattattagtcccattttacagataaggaagccgaggttcagagaggggaggtgacttgtccaaagcttatactcttaagtcagtggaaaagcctaccatggaacctaggtcagtgagattttgagaggagggcgttatctgcagaagtagctgcatgagcagagacagagaagtgatgtgtgcacatgtgtgtgtgcacaagtgcttatgcacatatgcatgcgtctaagggcccagagtctgcctggctggagagcaattcatgaggcgaatgaaacaggagagatgacctctgaggtcatcggggccagctcatgatgggcctcaaagtccagttggaagaaatggactttccctgaggcctgtagggagcaataaagggcattcagcagcgagggctgtggtcagattttggggagcagactcaggcttccaagtggcgggtgaattggagaaagctgggagtaaggaggctacagcagtagtctgcagggtggagggacccaggtcaggctaccctggctctgagctccaaagcctctttatgtggggcaagtcagttccaccaaagagaggcggagggaaggaggcaagggtgactgtctgcactctgtgactctatgaagcggcctcgtccttctctgcctgtccatctcctgtggctctgctgacccttctctctgccctggcctctattctacctcccactactccacatatacacgtccttctgtgcccgggcttactagagtcggggtgtatttgtgcctgtgtctacctatctttgtgtgttcacctctgtttatgggcttctctctgtagcctgtgtgggaatgacctgccctttgtcctccgacatgctggagttcatacctcactccaggtggaggctccaggagcccctaacaccagctttactgggaacacagggcctgggggcacagctagggacgaggctggggtgaagcggaccaggtgggctagaggacagaagggagtcgccctgtcctccctggagactgggaaccccagcaggatgaaataggggagggtgggctaattctggaaagagactacttgtccttcttttctgcgtaactttggcagtcatcagcattctctgagcctcccccgttaccatgagctgaggagaaagaggatgctccctgccacagcccagctggcggagggctctggtagggtctggaaagagctcttgagtctctttaggtgtagagggcctctgacaccccctccctccctcctccttcttgggtttctgtggcttgagcaggccccagctggagccaccgtccctcccaggagccgccgggtttgctccaaggtcaggtgtgtgacccgctcgtggagcccctgtaaggttgagaggcggatctgggtaagtgctggctcggccctccctgcctccatactggccaccaggatgagcctccaaaaccaggcccagtccatcccttccctgtgacaaacattccatggctccctatcacccacaggacacaaaccagctgctctgctgtaccctctgtccccagccacaccagaccttttccctctgccagccttcgcacatgctgttccctctgctgacaagacctcagtttcctcattcacctgacaaactgatgctcatcctgtaaggcccacctcaaaggctgcctgccacctactcagtggggacttcctagaccactaggcatcgtcattccctccctcagcctagcggcaccaaggcttagtgctttcttcattctgcctggtttcagagctggtttattcctgtctgtgtagtcttccatgaggcctagaacttcctccaaggcaagaatgaggcctgattgcgctgcctctatggaacttggcacaaggctaggtaaatggcacatgctcaattagtgctcgatgatggggagtctatgctgacctttcttacacagtggggctcagggaatgttcactgagtgagcaaaggaaggaaggagggagtgaaaaacttcctttatagcaatactactacatagtctaatttagtctaggtctgtctcccctcaccctcaatgtttcttgaaggcaggatctggcctgaatcttttctctgtccccagaactcagcacagggcctggcatggggtgggtggcaggagggggcttgagtgagagtacctgtgatcttatagtcaactctgagctcatcttacacagtggtgctcagtgtggctatgtatcaggattgtttaggaacttacaagcactaataacaagtattcatgttccacctctggatgttttaatctggcatggggcctaggcctaggaaacctgtagtttaaacctgtctcctggccaggcctggtggctgacacctataatcccagaactttgggaggctgaggcgggcaggttgcaaggtcaggagttcaagacctgcctagccaacatggtgaaaccccatctctactaaaagtacaaaaattagcaagacatggtgtaatctcagatactcaggaggctgaggcaggagaatggcttgaactcaggaggcggacgtggttgcagtgaaccaagatcaccccactgcactccagcctgggcaacagagtaagactccatctcaaaaaaaaaaattgtctcctgatgactctgatgtgcagaatcactaagcctagaagtgcctgggccaccaaattgtatagatgtggcactgttagatcctcagtggcttggagaggttacctaacttgatcagggtcactcaactcatcaatggcaggtctgggactcccagcccatcgttctgaggtattttccatgcccaaactaggatgcaagtttgtttaaagtggggatgtcaaaaactaggatttaacagactgtaaacctaataacacaacagctcagctaaggggagtcatttgcatgtgaccccctgattggtcaacactggttgtacccacaaagtagctgggcctctggagagggagaggcaggttcaaaccctcaggttctgcccatgggtctctgggctgtccctatttgttgccaggtgacttataggagtttacttctgggcctcccagacgtggagagtaaaaacaggtgccctcgagggatatggggtgctccaccctctccagggcctcccaaggccactggctcactgtgtagcagcagggcaaggtggaggctgtggacctcaacttccccaccaataaaattggacctgagagcttagatccctccaaccccttttgggcctggagcctggatcttggcactgcctaccagaaatccctattggatcactgatggggagggagcaccgtagagttcactgacttacgacattgcttgtctgagcctcttgcattgtcttgggactatatgttttccctgacttgaaactgaactcagagttgggcaaccttagttccagtctggccctgtatttgattcactggaatgaattcaataaacatttattaggtacctgccatgttccagtcagatctgattagacccagtctctgccctcaaaggcatctccaagtctgatgggagagacacagggaaacaacgtgaagacagcatgatcggtgctgtgatgcagggacatccaagggctgtgagtgtccagatgggaccccaacagaacctgaggttcagggagagtgatgcttgagttgagtctgaaagacaggttgaatgaggtgagaagcatatccctagcaaaggaaaatggcatggagatttgaaatcacaaggtgtgcttggagaccttccccttaccaccaaacttcttgaaagagatgtcatgacatggggattgcatccttcacctctcagcctttcttcaaccctccatagcttggcttttcctactcagcaactcctctgaaaagttttttcaaggtcactcacaacttccaagttgctaaaaccagtggcctattatcttggaattggccaaaagaatgggcagaagaacacatttagaagataaaatcacgagacctggtggctgatgtgtggaaagcagatgtgtgaagacaagggcaacaacctgctttctttccttctttctttttctttctttctttctttttttgagacaggatctccctctgttgcccaggctggagtgcagtggtgcaaacactgctcactgcagcctcgatctcctgggctcaagtgatccttctgcctcagtttcccaaatagctgggcccacgggcatgcatcaccacactcagctaattttttaattttttgtagagacaggttcttgccatgttgcccagactggtcttgaactcctgcattcaagcaatcctcccgcctcagcctcccaaagtgctgggattacaggcataagccgctgtgcctagcctttcttgatttgagtgcatggtgatggcatgtactgagagaagcatttatggggctgggtactttgggaggccaaggcgggcagatcacctgaggtcaggagttcaagaccagcctggcgaacatggtgaaaccctgtctctactaaaaatacagaaaaattagccaggcgtggtggcaggaacctgtaatctcagttacctgggaggctgaggcaggagaatcgcttgaacccgggaggcggaggttgcagtgagctgataccatgccattgcactccagcctggacaacaagaatgaaactctgtctcaaaaaaaaaaaaaagatttatgggaaaagcaacagttttagcagatggagaaatgttgcaatcatcttgagatgagtggagtttgagacacctggacttctaaggggagctggactgttcaggtgtgaatcccagttagagagagatacagggtggaatggggctaagaggaaagatccagaagagaaggggatcctgacccctctccaggtctgctcccccatgggtaaaatgaggggtttggagtttccatttaattcagcacatagttcttggttcctggtatgcacttggccctgctggtgacacaaacaaatcagagtccttgtctacaagcagctcacatttgggctgcaagaaaggccaggagaaaggatagcaacaagaggcacaagcaagatccacagaattcagggaaaaaaaaaattcttcctgagaccaggagagcttcctggagtggagtgggtgaccgttgagctaggctttgaagggttggcagaaatctaatgggagagaggggagggcagggaatgcattccagagagaacactgaccattctctgagcctcagtccccaaccctatggtcatgtggagctaatacctgctttaaggattagaggtggtgtaacacacgtgatcacttccttcaggacctggtacatagtaggtgctcaataatcgttacagcctagtgcagcctaacaattttgggtcaatgatggaccacatatacaaaggtggttccataagattataatggagctgaaaatttcctatcacctagtgatgttgtagccatgataatgtcgtagggcaatgcattacattttctacatttatatatgattagttagataacaaataccattgtgttacaattgcctacagtattcagggcagtagcctgctgaacaggtttgttggcttggagcaataggatataccatatactctaggtgtgtgccacctaggtttgtttgtaagtacactctatgatattcacataactaaaattgcctaaggacgcatttctcagactgtatccctgttgtttaaaagacgcataactgtattttagttacttctcatccctatccttcctttcccttccttcctccccaacccctgtttatttcctgggcctggggcttggccatgttcccctccttgtgactagtagagctgggtctttcaagtggcattattgtagagctgctagcaaatattagactacctataaggagaaattgggagccatagagaattttttgagctaggtgggaggccagagttggagaatgggtgtcactgggagctggatgtagggcagaagttttagaggaccgtggaccttgtggggagggcagggcctttctccaagagcttgctagtggctggaggcccatttctaaacttggggaggtggctccatggatcccagagaggcctgtgccaggcgtgggggtaggggaccaaatccgggccagggagttcctgggcacctgacatggttggattccccaggtgcgcgtctacagcccgtaccaagactactacgaggtggtgccccccaatgcacacgaggccacgtatgtccgcagctactacggaccgccctacgcaggtaagtctccagcgtgccccggggcttgcctcgatccagcaccgattcagcgccaggcccagcccacggtccgtaagtccggaccaggcttcatccttttagcgtgcacggattttcccaggcagaactctccgcaagcccctctccatcctgagactgggagagctctggaaccagcgttcgtctcgagctgacctcacccttctgggatggctcctcagccctgcggtcggcaatacccattcctgagccggtagcggcccctggtggctactgcgggaatgctgcctcctccccgctctggggcctggcggttgggaatgcccatcgttaggcgcctggtggttgtgcttagcgatctcagggtttcctcgctgctccgccctagcctgccgtagcggacccgtaggttccgggacatccgtagccgatccaaggcctgggagccgtagggtggagctcttcccgcgtctagatctgttctttgactggggagcaggagagtgggttcggcgccttacactgggttgggctggagtgatgcaggaagggtacgaagatcactctactccctcctaagtcgctgatcctcatgggctgtctccctctgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagt

SEQ ID NO: 37262 - DNA, 10742 bp, Homo sapiens
cctctttctcccccctctctccctcctctcctctctctctcctctcttctctgaacctctcttctctttctcttttcttacatattctactagttgttttccccttcttcttctcctttctctcctttttctccctcctccttgtctcttttactccattcctgcagaagagagagggctaaacttaaagaaaaaaaaaaggaggaggaggaggaggaggcacccccttcgtattcttcttatcgttattttatacatatatgattttttttggagggagggtgttggttgccggctgaagagcacttatttaaaatactaaaaaaagaacatttttgggcgatctccagggtttttttaactagctctgtgtgttatagcagaagaagcagaagaaggagcaagaaagaggaaaagaagaggattatttattcgacctactttggatgtctctctcgcttttcctttttcctttttttggcaattattttcttctgatttttattttttctatttcgctgtgatttcgtcgccggcgtgaattatcccgtatttttctcccccttccgtcacctcccgaaagaagaaggcagcgagagcccggcgccaccggcacaacaaaaagagcaaagtgtgtgatcttcctcgccggctgcctcccgctctccagcgctgccttcctgaatggctggctgcgtccggccctggacctggccccccgacacccgcgcgccctgatcgccggcggcagcctcgcccagcgccctgctcggctcaccgcgctccccgcactcccgagcccggcgagggctcccgccgggacagcggcggcgccgcgggcggccccggcctccgctcgcgctccggctgcggccccgactcctgctcggactccggcccgggtcccggctcctccagcggcgctcgccgcagcagctccggcggcagctccagcggcgcctgcagccgcgacctcctcctcctccgccgccgccgccgcctccgccctcgccggcttcctctatgtcggctcagcccgcgcgctgcgcgtagcccgagcggccggcgggcgggcgcccggcgcgggtgagcgactgtgtgtgcgagtgtgtgtgtgcgcgggggtgcgggcgaggcggagggcgagtgtgtgcgcgcgccgtggcccatgcccgccgcccccggcgctgcgccccgcgccgctcccggctgccgcctgtgccatttctgattttgcaacttggggaagaagaaaaaagcgagagaagggagcttgctcgccggggggtggggaggggggaaggagagcgcggcccccccaggaacggagcgcggggggagcgggcgaggggagcaggggtgttggggggggagcctgagagcctgggggggctgcaaaaagagagaaagaaaacagcaggaaccacaacaaaacgccagcagggcgggcgggcgcgcagcagcagcggggcggccgaggcagtagcggcggcagcggcggcggcggcggaggcagcggccggtgtccggctcgggctcggctcctgcgaccccggggcgcccggcgggccccccgccccctccccctccccccttccccttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaaggtgaatatttcttctctgcttctctccccgcgcttcgcccgcctccctggctctttctttctttctcgcccgggtggttgctgtgtggggctggggctcctgtggtcccggcccgtcccagctttccttctcccggctgccttcctcccccggcgtctccccccgccctccccagctcgctgccgctgcctccccctcccggcctgcgctcatctccccggctcccccaccccgcccgctgcctgctcaggattgtgtccctgagatcgtgagctgtggcttaaaatccccttcttccctctgtcttggatgtgctcggtgtgtgtctctttcccgcgtgtgcgtgaggctgcttggggctgtgctggcatgaacttggggaggggtgcttatttcccccagaaaactctgtttctgtggttttttttcattccacttttccctccacctcttcataccctttatttaaaatgggggagggctgggggctggagtaccctgaaccatagattcattgctgccatcatccttttggaagcttagctcggaaaaagaggagtgagatttattgcacttgtaggtctaattaggggggaaggggggcttctggcccgttcactggttccctctcttcttcacggagctggggccgcctcctccagagctgtggccttgttttcacccctctactttgaaaggaaagtttgtgactgaaccgtgctttcatagttgtgtcattttttttaaagcatgatactcgttttatttcttcatcaaactccaccctctgcttaaatactgcatacaaattacaatttacaacggcatttaccgatccttctgatttggccgtaatgcatagactgcagctagcatgagcttccacatcatttaatccctgtgttgtatgggtttgttttttttaaaaaaaaacacaacttttgatgttgtatttggatatgcttcatgttcatgtggcaagagatgcagtacttttcttataaatatatttagccgtttacagttaaagtttatctcttgacaatcattaaagatgtcttatagtcaaattagcgaaccagtcaattttgcagaatgcagattactccttcttgtaattgactttaaaattatattttatatgccacaagaaaagaaattgaattccttcagatctcaaggagcagacaaatatgactacttcatttctagctccagggagattttgtaggcatctgaaaaaaaaaaaactttgaattgtactctcacttaattgaaaaataactgccaagttcaaaactataattagaaaaaagtattctaggcattatgtttcaagagcttcaattgcactggaacttgcattaaaattagaatcaaagcaaacttaagaaaatagaacaaaacctgaaataagatagctacatgtacatgaacatatctatattaatttgttgggggaagagttcagtagccctaacttttcctaaagttgtctttgtttatatggcaatttaaaacgctggcactgttgaagtaaaacatacacatttaaaaaaaaaaaaaaaaaaactttggtcagctttaagaactcaaagcatgcttacgttttgcattcagatggttaatgaatccagtgtttttgcagttgaaagctcgtgcattcactgggcaaaagctggctgcaggttgcagtggcaccgcgcaggacagacattaattatatttcctacttttttcaataatgtttggctactgtaagttcaactttttttcttgaaaattttcaattttctgttgcttttaatagtgagaactttgtatggggcgacggggaggaggggagaagggaggggtgcaggatacttgttctctactcaaaagttgtaagtggttagtaggatatgtaacttgtgtctattttaagaattattctatagcattttaagagaatgtggaaacattttatcagcaaaacgctgcttgcttgcaaatgaggaggccgctaggcatttgcctagaaccacaacctttctccggtttcgcctttttttaaccctgattttttttttccattctggaggggtgagtggggtttcatttatctgtgtgttcccccgtggtggcttaggggttggatgacactttcttgaccttgccagggttggggccctggagtcaggcctagctccggcggggctgacgtggccaggggctcaggcagtggctggacacactgagctgtggagctggagggcctcaccccagatctcctagcggtgtggactgtgagagcgagccggagaagatgcgcggggcgcgtgtggctgcgggaagagcttctgcattgtgttgggtacgctgcggcgcggcaatgttcgcaagctccctggatgcacattgcctcttttctctctttctttttgtcagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcaggtgaggctgcggtcgcggggagggcaggccgcgccggcagcgagcgcaggccccgcgccgcccgggcctggccttcggagcctcccgcgcggccggtgcggggcgggccgggccctcgctggacactgagcctggcccgggtctgtgacccccgcgcggtgaccggctggccgcgccgctgccatcttgggagcgcggcggtgcgggaaccgaggcggcgcgggtgcggccggcgggcggccgggcctagtcgcccggacccctacgtggggccgcggctgccgagggtgtgtgtctgaggcgggggggcggtgctgtggatccgtctggctgcgcgcgcgcgcgcgcgtgtgtgtgtgtgtgtgtgtctctgtgtgtgtgtctgtgtgtggtgcgtgttatgtgtgagccagagctcagcgtttctgggggaggcgagggaaggaagagaacgtgggaatgtggcttcttaccctgtgtggcactctccttgaatgaatttcccgacacagagagacacagagagaggtggaaagagaagaatacgcacaaataaatcataataatcccgctttatcgctgcctgattttcccttatcggaaaccattcatgtttgcagttggtgaggttattgagggtcgtaaaaaacggattcgatctaaacaagaaagataaaaaacaaaagcaatgctgtagaacccgcaagtatgggaggattccccgcctgaagatgaattccaaagctatgcaaaacacatgaacactggaaatttaagagtgccttaaaaaatatcaaattatgtgtaggcagtggtaacatgcatgttaacaatttctcttatgatagatggttcaaattaacttccagaaaagtgcattaacgtttcctttgaagggctctggtctgagcctccgagaacaatccccgctttttattattgtaacctgtaagagggaaacatataaacacccaggacagcaggtaatggggagaaatagagacaaagccagagaggaggctggtggcaagtagtgctgcttagactgggtcttgggccctgcccactgtgagtagggttagctgcagttttaccaccattattggcagtattgtttttaattcctccattcggagaacaaataaaccatcctaataaatctatcctagaaccaggctttccaatggccaaattaaaaccattcttgaacagggatagcaaaatccctttcataaggccttgttgaacagtaagcaatggtataatctatcaatatttcttggctttcatgtgtgaagaattgtatttacattgtattaaaatgactcctaaatttgcacaatattgtaatgtagcaaatgtagtattaatatcgatctgaacagcagataatttatttagacaagagcatctcatttgtatgcagggtggccagagcaatggacttggactgccccccttttactttcagtgcaaatgcaggtctgctagtgagagagggagttattctttccaagaggataaagtgcaaaccttaaaacaaatggaagatttatggaatagcctcctccgtatttgaatgcattttatcttaataagtcttcttgatggaaacgtgtttttcaaaagtgacaaagagcctgggaagcagcaaccaggctgcctcagctctggcaggcctggggcctggctggctctctactaccaggctctttagccaaattcatcaggaagcaagccagtgtcagggaagctggggtttgaaaatctcatccagcgaggtgtcttgaagcagaaatgtgacttggaactggacagacgttttctcaggaaaggtctctcctctcttttccttacaccccctaaggttctttgaacccccttgactttgctaatctcatgccctttcccagagagaggtgaggactgtgcaggctgcagggaaacactgtggaattattcatgctttccttttaactttccatactaaaacattcctgtgaaaagtgttcatttaaaaagttttccaaggaagtttcttgaatcaagtcttcaaggtgcaaagagtgcctagaaatgaacaataacattattttgttggaaaattgcaagcagaatatctgaaaatggaaatagagctgtcagtagtaattcacctcccccctcccatgcaacacatttccacttttgactaaacttgttttgattgctagccagaagggaattcatgggaagccttctcaaagtcatccaacttttaagcaaactttgaatgatggaaaagacagttttagacatattgtccaatgtggtttgctttggctaagtatttgaagctggcacgggggtcccccgtggtggttttcacatttggcctccggatggtatgtttaatccttaatattctggactgcatccaaggactaggtcatgacctgaacttactttttaaaaaattcattagttcatacacctaaatattccttcaaataaatgagactttctctgaaaggagccatctagttaacataaatacaataaatccattttcagcacaataataactttgatttctagttatggcagctgattacatctatatttcctgaacactaaactcttctgaatgcacaacatgaaatacattctctgcactacaaaggctaggccaggagggcctgagcagtaatggttatttatttacataatttcttttccatacactgtagaagaaatattgagagttcccacattgacactaccgtataaaaagtgtgacatggattttgcacattctgcctcattttcttatctggggtataactcatggagcataaatatatactgtattacaccccctggtcacctagctttgtcaccacaaccccctagttgatctgggagctcataccttctgtccacagttgagggaatcctgttgcaaaggggtgaatgaatttccagactgggaagccaggccagaaccagggctcctgccggagggaagccacagagctagctggctggtacctggcaggcaggcccagctacaggcattcacctccaaaggagggaagaaatggaagcaaccagcacaggacccaggcaggcctttcctgggcttcttgtctctcttggagcggcctgtttgggagttgggaagtgaccttgtactccagggaccctaatcataaatgtcagatagatattttactgagctgaggggatgccagatggatcttaaaaaaaaaaaatctgccgggataccaaggggcccttttcacattgcattgtctagggctgagaatgatccataagcatgcaggcagataatgcatgtaaagcaagctctatgtaattatgggtctgggtctgagtgagggtcattcatcagggccaggttagcaagcagggccaaactcacggtcccctctctaagcagcaaagccccacagagctcttgctgccctggccctaatagccataaagtctcatttggcttcccatatcagaccagtgtggatatacccaactggctggctggagtaattagacatctgagaggaacctagtctgtatctgaggtcaaaggggacttgcctcagaagttcttgaattatcactagttttatttgtatttttgctcgaggccatagccttgtagatgaaggtgttagaatgctttgtaaatcccagttcttgaaatataaggtcataaagctcagaaactcagcagacacaggtttcactttgaatcatttgttgtgtcttcttagggtcacacttgcccattcaaaattatacaatgtcattttgggggcattgccatgcatcaattttttcccagatctatatattagcaaattctgcctttgatctctagtcaacctcctgactggctaagggctcctctgtgatcttactggtttttttttaatatttattattaatataagaaacaagtgggtatttgaactaggagaggatgcctttactccattcctcttattccatctttccctccctatgcttgcctctagttagttgatataatataatctgctgtcctgaaatacttttagaggaccaagaagggccttggttgacatgaactaagcacacagattttgaggtgctgtcattgtgcggaggtgcctttttctcccttggtcctgccaccaaaagcttatctccccccaagtcccccctcaactccccaccacccacatccccccctacccccccagttctgaagcagcagcagctgctgcctgtagcctagctttgtgtctgattgctgaagatgtcgcctttctgcagcctggagtaactgagtcatattcttcctgattattatacagcttacagagatgtgaccaattttcaattacttgatctaaggtatagatagaagtgtacaccctcaccaaggatttgctgcagagtcctttcttgcatagataacggatctgaaatcctatattgctaaagcgtgggcttcatctgattccaggcactgccagcccatgattccttaccccctcccatgtgtttgttcactacacaatctaggttctcctggaggtttctggttggggtggtttgggtttgagaggggactccaggaatcctttaagaactgccttcaggctgcatatttcctaaggggtactgaacacccccagatcagaggcaaatggggcaaaagttaatgagcacggccagaaagatgctcccttgcaggccgaggacaggttgttaagcgcagcaaacatggttccagcattgtacattatttaatccaaaggtgaaagaggaaaaacaaagggactagagaggtttctgcctctgcatgtgtgtgcctctctctccagctcccctaggcttggtgggggtttgatttatttttatttgtattgtattgggggcgggggaggagggaatgaagaaggggatggagaggtataggagggtgaatttttcttttctcttttacttcttttttattttccattttctccttaaaaaaaattgatggcttattttgcctttgctatttgtcagcctaaccgtgtgctccctttccctgtctctccctcctgtggctgcttgggcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaac

SEQ ID NO: 37263 - DNA, 11829 bp, Homo sapiens
gtgcatgggtttggaaccagagtaccttgcccacagaaatggaagtctggggacccagttggatttctacaacctccagccttagcggcacccttttctctgatccgggaggggaagagaagccatagggttccccagtttatgcccaccctcgtctggcctcctagcacgagcagtcagtccctcccctggaaggaaaggctgaagggaccacccaagcgcttggtccaactcaccccgtttctgcaggcctgctcgttcagcgctcgcacccaagcccgctgccagttctcccggaaagacttgaaggcgaagagtgacgccaggaggccccggactcctggctcctcggcggcgccagcccgagtcgcccgcagccgcagcagcgagcgccacacgcccagctcccgcagggaacccgcgggttccccggctaaggcgggtcccgggccccggtccccgcgggcccgcgccagccacaagccccgggcatattgcagcagccaggcgaacaccgtgagcagcgaggcggcgaagaggatcagcaaggccgcccagcccacgtcccgctgcccccagcccggatccatgctccgcgcgggctccgatcccggtcccggctggggctcacccgctgccccgggggagcatggcccgggcgggccgcggggaggaggtgggctcccccggggctgggcgcgcggggtcgggggctctccgcggctgagtgcccaggactagtgggtgccacagggcgaggagaggaggtcctcgggggtcgcgatgccggggtctctgtctccgtggtccgggtctctcctagcttggtcagcagtcggacccgttagtcgccggccagtgcccgactcctcccaccgcgcgggccccgccggaccctggaggggactggtctgcagagacgctggggctcgcgggccggcaccggctccgggagggctgcgtgcgcagagctgacactgacaacaccgccggcgccccgcccccacccgcccttaaaggagccgcacccgcgccgggcggggccaggacagcctggcgctccctcgctggaggagggcgggagggctagcagcgagcggaggaggttccggggttgaaaataggcgggatctttgatcacctcgccccatcttgcaatcgcggtgctcccacactcagctcaaggcaagagtaacttcacttacctaagatgctgcctttgctttcccctatgcttgttagatttccacaggtcggacgcctgtgaggttaagaaggaggtgacccctgtggaaatcaccgcccccttctcccaacacccccagactcagcgacttctagcttcccatttcctgggggaagctaggcccagggtaaggagacgcagagcgtccctcccagatagaagtgtctggcagaggtccagctgatgtcaacagagagaaagcagaacctgaagctgggagaggttgagagtagaacaccgaatttgaattccccccaccatcatcaccctccttcctcttggagcttggacccagaaacagccccattaacctccttgctcgtgtaggtttgttctggagattcccaagcccaggctgtgtgtctgtttttaaaaataatgtatttccatagtaacagctcctgcctatggagcacgtgtagagggggtggtaatgacaagggagctggcaatgtagcactggactatcaatagattcagccacaagaccttgccactctaagtatgtgatatcccaacaagctcccaagaaatggtgctgtaggtacactgcccaacctctggcctcagaagccatcttttcctagactcaaggagttgattcaacctctacaggactggggctcatcaatgcttgctgaggacaggggaaggaaatacctgcaaaaggattcaaaggaatcctgggggaattcacattctcccaagagccccttcttcatacatgtgggaaggtctttggcacacagtccctttcttaaagaggtaggatggaaaggtgttaagtatctttctcccaaacccaagtagttgtctgaggaatgagcacatgagaataagagaataaacaatgccttctgaagtgtgggatggcagggctagacagaaactgacaggtcagcaacaggtttgtctgagccagaggaggtggtggggtagcctgggcctccctagatttccctgtaaggaatgatggggagaggtgggggtgaatgaggtaacctcctgtggccctgcccatgcattgtcactggactgccaaatcagtggagattcctagagtctgggtttctaatctcaaagggaggagaagacatgaaatcaagggaggagagaactcagggccagaaccagggatgcaggaggaagctgtcagtgggaagagcagctagggtttaggggagcaggttatgcaggaagttgtccaggtagaagctttccctatgaagaccctcttcccccaagaatccttcaggaaccctcagaccccctagtgatctccattctctgacttctttgatttattccctcaacttctccactgagtgcttggtcctatgctgccagatactgcttcacaattcagtatctgaactgtgagtctacctagttacatgagtctccctagttagtcctccctctttttttttttttttttctcttttcttgagacagaaagtcactgttgcccaggctggggtgcagtagcgagatcttggctcactgcaacctccacctcccaggtttgagtgattctcctgcctcagcctaccaagtagttgggactataggcatgcgccatcatgcctggctaatttttgttatttttagtagagacagggtttcaccatgttggccaggctgatctcgaactcctgacctcaggtgatcctcccgcctcggcctcccaaagtgctgggattacaggtgagagccactgtgcccagcctagtcctccttctttcttccattacttagacctctagcacttacattctgccttagagtctagctgattgtttatatgtctgctttttccatgcatcaggaagctgcctaggggtgggaaccatgtcttagtcatctcttttccctcaaattcaaccaagatgctccaaatatgctgaagtagactccctgggggcaagcaactgcaattatattagtttgtatcctccacagtactgaagagcttcctatgcacatagtagggattaacaaactttgtaattttaagaagtctaacagaaaatactcaagtatgctttgagaatttctatgccatttctgtcttttgaaatatcattcatgccataccagtggaatgggaaatcctggggcttgcttttaattaacaacttttttctagactaagaggggagaggtgggaggaaaaggaaaaagagtgattcagctgactggacagagccacagatagagtcctgcaagtatcacagccccagactatccagaggggtctcattgtctttgtggcactatgaaacatttttgggacaggctttgtctagcaatcacattcagtggattggccttgctcattgggagccactcaaggctacttagaagaggtgtgcatctcaaacactgtctgctcagtccagggccactgacaagtcaactggtctgtgaatcctagggccggcttcagcattcaggaaaacgctttgaacttttaccagggaaggcacacaatttcaagtgaagccaaaagtcatgtgtttgtttctccttctgattagtctgatcatcaactgggactttatcatcatgggaacaaaaatactcagattatctgacaagtatcttagtaaccattttctgatagtaacatgtatatgtggatgatgaatccttagtctctcttgtctttgattacatccttccaccctccccaggagggtggtggtagggagggctaatgatctctggagaagaaagagataaagcttcccaataccaggctgggaaggaagatttattaggattggcctcctaataaaaaaggaaatagatacagactggctctcagacctccagggagtctcagtatactcgtcatcaacaagataactgaatgctgcctcctctgggatcccacaagctcctcctttccaccagcttctggtgtctcactgtcgctgcctgtgaaaggtccttctactcttataatctactgaaatgatacttctcttcctcaagaccacttactctggtcacaactaattgctccctccatatgcacctattgccctcagtcctcctttcagcctcagcctcattatgtgtgatgatgccttccttgtacacagatgtctgtgttcctagccccatggggacaccctgtggaagagaaaacacttgcctcccgggagtttctagtttaaaaggggcacacgtgcatacacacaacacacacagaaaaataatagcagtgggataagtactgaaaatctggtggaatactagcaagtaaattacgaaaatttatgtattttatacatatctgggtttttgttgttgttaattagagccattttcaagtagaaaagccatttcacatctgatttagtttgtttgtttgtttgttttgagacagtttcccctctgttgcccaggctgggatgcagtggcatgatcgcggctcactgcaacctcctcatcccaggttcaagcgatcctcctgcctcagcctcctgagtagctgagattacaggcatgtgccaccacacccggctaatttttgtattttcagtagagacggggtttcaccgtgttggccaggctggtctcgaactcctgacctcaagtgagccacccaccttcgcctaccaaagtgctgggattacagacgttagccactgcgcccggcctcacatctgattttgagggaaagaagaaactatcttcggcttaaaaacggtcaacatgaccctgactcctggaacatgccatagagggaagagtggacaaagcgctaggctattggagtcctttccctaactcactggtggtgacttcctctctgacaaatggaaatcatttgccgcctaagagcctgtcggggaatgaaaggtaataaagatgctggtgaactggctgggcgtggtggctcacgcctgtactcccagcattttgggaggccaaggcgggcagatcacctgaggtcgggagtcccaaaccagcctgaccaacatagggaaatcccgtctctactaaaaatacaaaattagccgggcgtggtggcgcatgcctgtaattccagctactgcctgtaatcccagctactcgggaggctgaggcaggagaatctcttgaacctgggaggtggaggtttcggtgagccgagatcgcgccattgcactccagcctgggcaacaagagcgaaactctgtctcaaaaaaaaaaaaaaaaaaaaaaaaaaaaagctggtgaattgttgtttgcaggggaacaggccaagcaaaatgcacagcaacctgcaggaggccaagcaaaatgcacagtgacctacaggaagaaacctgactgggagttcctcagactcacaggaaatcagttgtgggtctgattcctctccctcctcagctctttccagagcctcagcctggaaatctccatctcctccttgtgggagctaggtacaatgcagtgatccacggccaagctgaagtctcgagttaaatccaagacctgagggtactcccaatccctcagtgaagtgctgcgctgggttgccgggcaactaactgctacagctggggcagaaggtgggtgggatgctgagaaaaaaataccagaatcgaggacaagaaaaacagagtgggaggggcttttcaaggatctacgctttagaatttacaccatccttccaaatcgtagctttgtttccgggaactgagttgtgtttaccttggcttccgactatgttggcaacaggtttcctgcaagaaacaggcgcgtctccacaccctcgtccctcctccccaccccctgcctttcaatagccatcttcctggagccggaggcatcccagattaagggagaggtacgggccctttaagcttgacctatggaggcggacggagctaaaactgacgtggaaccggaatgtgagcggtgtcagacacgtggtacaaggaggcattcatcttggaaccgggcaattggcatttccgctctgggtagtacatctttaacataatgttagggaagtatccgttcttggctgcctttctttaattgcgtttccagtactctctcggtgattctactcttgaacataggatgaaatttggaatcacacttctcttccacttccatccccaccctctaatgcccatattaaaaatggcggccgccgccttccgcagtaatggttgttcagcgaacaagatccgggcggaaacagtagataggcgggtgcagcggggcagaacataggttgccttagagaggttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatgtgagcagcggcacacgggtccgggcagggggcaagggctaaggaaggagtggctagggcaggggcgggaaccggggtgcttgaccacacgtgaagactcagaactaacccaggcagcctggaactcggagaggtgatgagcagaacttactcgcattggggaaaggatgggtagggacccttgggtatatctgggactctggcagtggtgctttcctccctccgcccccctcaccacttaccagaataaaaaaccgggaatgagaagaccactttgggttactgtaacacctgcactagtgagtgaccacgccccctttcctcttccccctcgcccccttgctgctgggccacagcccagaatcccagggagtgatcagcggtgctgttttccttatcatcctcttctgcttcatccctttccccttcctgaactgctttgtgaaggagcagtgtaaggcattcccccaccatgaagtaagtgggttcgtgggggtgattgcctgtggctgggacctgggaggtacctgagagaactggggttatttgggcttgtggggaggggctaagaaattatcagaaaagacaggaattcttaaaaggtggaatgggagcaggcttgagtcatggacctgcccgagcctcccccagtttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggtaggtagtcctaccactgctgcccctatggcacctacttcagggaacccttcctggtgctccacattctcctccaagtgttccttttttgtctctgtgtcttcccagatcctttctggtagcccttcatcctatcgtccgtcctcaccacttttctaaaaattcttaaatcctcctcccctaggtggcactacttcttttcctaccatctctccccgcaggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtaggtgggattgggggtggggagagagaagtctgagtgttaaaggtgtggcctgatatatgactttgggaaattcaggggaaaaaagcaatatgcatagtaattatagaagataagggaagctacttactttgcaaataacaatgcagatttattaaaagtgagaaagaaaaatagtagccctgtcatttatagctggattggcactaatagctaggccatgatcttctcccattgaatataaacagtttcacagaaccccaacgttacacagggtcattctgtgaccgtgatggagcaagactaaaactagacccctccctctgtaatcatgtttgagcacaggcaaaaccacaagaacactgagcaacccacaaaatggccaagatcccctctctcggctaacatgagcgactgctgctgctctccaataacaactcagttcctaccacttcttttttttttttttttttttttttttgagacagggtctccctctgtcatgcaggctggagagcagtggcgcgatcttagctcactgcatcctctgactcaaacgatcctcctgccccagcctcccaagtagctggggctacaggcatgtgccaccacacctggcaaatttttgtattttttgtagagacagggtttcaccatgttgcctaggctggtcttgaactcctgggctcaagtgatctgccaggcctcccaaagtgctgggattacactcttgagccactgtgcccagccagttcctaccatttcttaaataaacattaaaatgcttgatcatagaattactcttgctttcttttcttttctttttttttttttttttttgagacggagttttgttcttgcccaggctggagtacaatggtgcgatctcggctcaccgcaacctccgcctcccaggttcaagcgattctcctgcctcagcctccctagtagctgggattacaggcatgtgccaccacgcccagctaattttgtatttctagtagagacggggtttctccatgttggtcaggctggtctcgaactcctgacctcaggtgatctgcctgcttcagcctcccaaagtgctgggattacaggcgtgagtcaccgcacccggccatgaattactcctgctttctaacagcacccagtccagagcaaaactactttctttcaccctctcccaaaatacccaaaacaaacgctactacaagcccctcctaacaccctcttactgagacattccgtggttcccaatggtgtgtggtttctgaagtctccctttttacaacaagtcattaaacctagctttgaactatagatgtgtttctgatggtctttggctgatgaacatcaacaagtgtttattaaagctaagtactttttaaacactatcttatttaaatcttgtaatggttttatgtggcagatgttataatcagccctgttttacagatgagaaaacaggcttagagaagttaaatgtgtcatgatcaagatcaaggtcacaaagctaagaagtaaagttggtatccaaacttacatcagaatgggctaaaccaaatttaagatagtaactagtttggaaggctgcacgaaagaggtggaatattgggaattgccttgggtgacataaaaggagtattgagttcttaaaagtgacttgggtgaggtggatgataacagctgtaaacagaacttagacaaaaataggaccaaggtttgcagaggaagtgggtattaacttttccttctttcttccttgcttccaaaggtgattgtcgggatgatcatgtcttttccctctacttcatgatacccttttttttcaccactttgggattgctctaccacaactggtaagtaggcctgtggataaggggacaactacctgaacacatggcaaagatggcccttatcataacccaccttgtggtggtgaagctaaacctgcgcatacctctatggagttttctgcgtcttcagttggtcgtattctgaaatttctctctacccagtagtagttagggatgagtgcgtggaggccccaggaatagatgaattcagggccttggatcctgcagagttgctgcacaactggagtctcctctgagtcagaactagggtcagggctagtccagtgcccatagggtgtgatgtgagagaagggattggtaatgcctcttgccactggctcggatcctcttcccccacacaggtacccatcacgggtgtttgtgggagataccttctgttactttgctggcatgacctttgccgtggtgggcatcttgggacacttcagcaagaccatgctactattcttcatgccccaggtgttcaacttcctctactcactgcctcagctcctgcatatcatcccctgccctcgccaccgcatacccaggtagccgctttttggcttgaaatggacatcatagccttttcacttgggatatctaatgccagcctatacatttgctgtgcaaagggagtgggcccaaagaagggctatttccatgtgagtagccctttataacttacaaagcacatttatttgcataatctgctacagtggttctgataacagtaagcagcagagccagaaatagatctcaggttgactccacattcaatgctcttcctattagccacagggaggagggttcaaatagtggcccagtcacatgaagctatcttccccccgcagactcaatatcaagacaggcaaactggagatgagctattccaagttcaagaccaagagcctctctttcttgggcacctttattttaaaggtaacagggtaacaaggaggtaaggccctaggctgccatcctgaccttgaggaatggggaacctagtcctacatcagatccaaggggaacttgaaagcattaaatagatccacattcctaaagcataggtattagctgaggttctcttcacctctggtccctccaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcaggtgaggatgggaatcgagtttatacctccgtgtctccctttctgcgtgattcttactccagtccatttctccttgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttattgttta

SEQ ID NO: 37264 - DNA, 12966 bp, Homo sapiens
ccaagatggcggcctccatgtgcgacgtgttctccttctgcgtgggcgtggcgggccgcgcgcgggtctccgtggaagtccgtttcgtgagcagcgccaaggtgaggtcggggcgggtcctgccgggagcctctccccagtccggccatggagacagcccggccggactccatgcccggagcccagaggcttctgtgccgctcggacgctacggccctgcccctgctcgcggcccgggggctcccagtctgtccctgcgcgcaggctcgtggcgcggtcacgcgatagacccgggcctccggagtctccgtgcgcatttcctcccagcggaattcggccagcccgcgggaggcccttctgtggctgctcggggcggggctagggggctttgctgctgtatccctggaacggtgggcggggatgtgccgggcagagagaactgaggtgtaaaagagggagtcctcacgaacttcatgtgtgagatttgggtgaggggatgaggagagaggccaagatccttcacgagggtccttggagtgctgaggaatttggaccagagtccaaaggccgtgggggcattgggagagtttttagcaggaaggtgacgtgattttgtcgtttttattgtgttccaaaagttcattgtagaaaaaaatacaaaatgcatgtaaggaaagaaaatacaaaaatcacccatacttctatacttgtgcaaagatgagtacgttaaaattacatttttagaaactgctttttgatgcagcagtgaatctttcaatatcaagcctatttctacatattaagttttaagagctgagtagtagcttcttccgtgagagggtcacagttcactcaaccaaccccttattaatggaccctttattgttgtatggtatttttcatccccagagtcaaaagtcttagagctcattttctgtgcaaacatcctcttgttttgtccagcagtatttttttcctagttatctttgcctattgatatgtgtaaaattatatttgttctcatttacgtttctttggttactagtgaggttgaataatttatcctgtgtagtggctgtgtgtatggttggttcttgcccaagacgtaagacctctagttgtctgttgtctgctctcagcgtcatcatattgatctagttttccagctcaaccttccgtgccccctttctgctctagaggtatctggagcagtttgctccttccctggtaaatcagcttccctacatccctggtctccttacctgttcctatctccatctccatagtctctagtgctcctgggtggccacagtttgaaggcctctcagttccatcattcttggtttgcagtgatattcttcacctttttcttcattagcccccagtctctcagccccttcctttcttcatttcttccctctcgcttcttcacttcagccactctccttgcacagttttcctgtcccaggcttctatcaaggccctagctgattgccctctccttgcctacatctgatctgctgctggagaaaataacatacctgcctggacttggtaacagcatggattatcctgggctttttgcttctctattcaaatgagattggtttgtgatttttttctctgtgttattttcctcaagttgccacatgagggttatacttgtttttttttggtaaaacagaaatgctttctgtcattacattgtttaaatagcatgagcattatttattctttaaaggtttgagagaattgggtcatgaaactatatagaccaggggcctcaagtgggagtagtttttgactactgtttattgcttctgtggataggaatgacttttcaaaaatttatcaactattatgccagagacatgaccagtcagaacagaaacctcaccaggtccagtggaagccagctggattaccatactggtgcactagccggatagcagcatggcttattgtgggctttcttcttttaatcaagattttaaaatctactacatagtctgcccgggcatggtggctcattcctttaattccagcgctttcggaggccaaggtgggctgatcacttgagatcaggagttcaagaccagtctggccaacatggtgaaaccctgtctctactaaaaatacaaaaattaggcctggcgtggtggctcacacctgtaatcccagcactttgggaggccgagaggggcggatcacttgaacttgatgtcaggagttcgagaccagcctgaccaacatggtgaaaccccatctgtactaaaaatacaaaaattagtcgggcgtggtggtgcacacctgtaatcccagctacctgagggccaggcacgagaattgcttgaacccaggaggcagaagttgcagtgagctgaggtcgtgctactgcactccagcctgggcgacagagggagactccatctcaacaacaacaacaaaaatctattacatagtcttaagagttttgcactatttttttttatagagatggggtcttgctgtgttgcccaggctggtctcaaactcctgggctcaagcgatccttcatccttgcttcccaaagtgctagatttacagtgtgagccaccatacccggcctgcacgattttttcttaaaacttttttttcaaattggaagtatgtatggtttgtcccctttccattcaggttcagtgctctccaaccttctttttttttttgagatggagtcttactctgttgcccaggctatagtgcagtagtacaatcttggctcactgcaacctccgcctcctgggttcaagcgattctcctgcctcagccttccgagtagctgggactacaggtgaacaccaccatgtccagctaatttttgtatttttagtagagacagggtttcaccatattggtcaggctggtcttgaactcctgacctcgtgatctgtctgccttagcctcccaaagtgctgggattacaagcatgagccactgcgcccggcccaaccttaatattatgagttagagctctgttttccttgaaatatggtcatcagttttgggaatgactttataaaggaacaactctgattcttttctctttgttttgattacgaaatattttctgcatttagtccttcacaaagagagggagatctatatttgtccaatattgaaatttgagattgtcagaaataatgtgagtccctgttcatattgtcgtgtcccatagaggaaggccaagttttcaatttgctagattgggatgggatacaaggcatggggagaagggcttccaggaaaccaggcaagggtatgcccagggctttgcctcctggttttgtttcacctgtcccactctactgtgagatagagcttccagagttgttcacagggttgagatttttcgctctgaatttgagaggcaaccgtatctggccttctaaggaggcagggagctacctgggaggcaacactgacaggtcattttgcttcagtgtcaagcatttttttcctctccttttgttgtggcagctcagtgttgacagggctccacacgtcttctttgagtagtgggagtatgtgcccaataaggccagtaactgcctgggttctgaagccatctgctgagtccttttgcacatttgagagatggcagttcagaggtttttttctcattcttcatcctttacatgatgtatatagtgttttagaccagtgcttctcaaactaacatgcatatgaatcacctgggcatcttgttacgatgcagattctgattcagcaggtctggggtggggcccaagagtctgcatttctgacagagtcctaggtgatgcccatgttgccagtccctgtaccctcattgagtaggaagaagctagagctcataaggtccattcatctgtgctatatcattacaccctggaaactaccttgtaggtattattataatgctcacttttcaaacgggaaacagatgtaaagtgaagcagttggctcaaaggttcacagcaagttaatgttaggactggtactagtattagctcctttctttcagtgcaaccaccaaggacttgttggatgccaggcactgtgctaggtgctgtgggtattcagctgaccaaggaagaaggcacattctcccccaaacaaggcttccctgtcccatggtgtaggatttctctgcaaccctgtgtagcaacaccactgccaggatcctggagtggcatgtggctgactcagagatgagtgccctgccattatcagctcctggtactggaggccccagcctgctataagccttggccctgctctggccatactgagaaaaattctctcagtaatctgagatggctgccatggtggctgcctccctgttccaggccttctgctctgaatgggctgaaagggatgcaactgaaaataggtcagagctgtatttccagaggagaaagttatggagggtgctaaccactctccatgaactcacagaggcagaggcctctcctaagagtgaggcatgtgggagtgaggctggacagcctcctggaagctctcggagctatgtcttctgttcctttttatggccatcctatccctctgccctctcagggaaaggggctgtttgccacacagctcatccggaagggggagaccatcttcgtagaacggcccctggtggctgcacagtttctctggaatgcactttatcgctaccgaggtgagtacatctctcctactcctcatggcccagtcgtctttgtgcatggaagtgagctgcatacatccctactggctgacgtctctggaactctgggtgttgggaggaaatgctgtcttccattgaaggactgtgcctgagaaccatgcctctgtccagtctcaggtgtttgaggcttattcctgtggtgggaggctcttcagatgtgctccctgagggagcacagcaggacttaggcgagtttgattccatggtatgagggacatcatgctgaaggcccagtgccaaagtggagtcctccaccaagaggaggctacatggcccttgttcaaagaaggctgagttaggggtgagcacaagtacgatgcccttagctttgctggccacatgcttttttcacacttttctttttttggggtctgggggagggggacggagtttcgctcttgtcacccaggctaaagtgcagtggtgcaatctcggctctctgcaacctctgcctcctaggttcaagcaatcctcctgcctcagcctcccgagtagctgggattacaggcacacacaaccatgtccagctaatttttgcatttttagtagaaacggggtttcaacatgttggctaggctggtcttgaactcctaacctcaggtgctccacttgccttggcctcccaaagtgctgggattacaggcttgagccaccgtgcccaacccacacatttcttaagctagagagacacaatgaaaggagggtcagttggccccagagtatgggaaaagcccagtttgggggtggtaggggagccccacagagtgagtctgattaagaagcaaggaaagttagacaataagggccaggaggtccttgagagggaggaggggatcatctgccttgggatgcacatgaaataaattcattcatccattcatccatgcatgtaattattcatttactcactttccaaacctttatgaaacactagaatggtgcctggcacatagcagctgctctgtagggctgtgaaagggatagatgtggcctctgctctcaagatattgttgtgtctggctctcaccgtcagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgagtattcttggggagtgtacctggaagggggtgggtgagggaggccttagctggagtcctcagtggggagacaggagcagcgacagacctggtcatggcccttgaaaactacaatgtaggataagatgttgaaaaggcttggttattgttccagtttcatcctccctggcacagttacattgtctggaaaatgggcttggtgggagctggaaaatgggcttggtgggagcttgctttcttcctggggacctggcaggggctctcccctctacctgaaaagttctcttccctttctgtggttttgcaagcctaggtgtgcctttcacatatccccagagcaccctatgttttctcttctcatgatacatctgagctacagctcaggggctatttgtggaaggaatgcagttagaggaggtgattctagggccagatccttgggtactgacctctatcccacctaacaggtgatgtactgcagtgcagaatgtcggttggcagccactgagcaataccaccaggtcctgtgcccaggcccctcccaggatgaccccttgcatcctctcaataagcttcaggaggcatggaggtaggtttcttttcctctcttctttcctttatcctttcctccctggttgcctgcctgggctcatcaggtgttgccgtctttcttaagttccaattccccggatttttcttcctttcttagggttaaacagaagtcacataaccctatcccctgcttttaatctgggctgtcagtctttctgtccttagcatttaacgctctcccagaaagagccccattaagccaatagggatgcaaagtcttgcctaagtccttgtctatgactttcctggtaattgatggaattggtaggaagttttctctgtaccagtcagactcggcttccctgagctcagctactagggagagaatttctaggccaatcttttttctctttccccaggagtattcactacccacctgagactgcaagcatcatgttgatggctaggatggtggccacagtgaagcaggtgagcccacccaaccctctcggggaagctgactttggccccattcaacccttggtctcagtcttttcctcacctcaaagccctagcttggatgcagagttcttcctggccttcccaaaggagagctccttgctatgtaaaaccttcagaatgcactctgaaggcatagggagtggagagctcgttttgcctgtagtcttttttttttttttttttgtaacttaaagaccagtgtgatagtatgcctgtagtttctgatatagaagatgccttgtgcagtagcaattcatgcatttgatttataagcaccgctttttcaggattatgtcttacataaagcgagagaagccactctaaccacccttctattaatattgttcctcagcctctttctcctgttttccaagtgttgttgaattggctatcttggctacaactggggagatggttgtgggtgggcagcattgggaggaagcctcaggcagaggaagggcccctataagttcctgtgtagtggtatttcccaagtgggcgggagtgccagtgagaaggtgggtatctgtgacccttaagtatgtttgttcactgcaggcgaaggacaaggaccgttggatcagactcttttcccagttttgtaacaaaacagccaatgaagaggaggaaattgtccataaacttctgggagacaaattcaaggttattattctcccgtggcctgtctccttccctccccaaatatcctaggatgtctctggccagctgtggggagcaccacatttgatcacttctgagctacaggaaggagttagaacttgggtccagaaatcgattcagaggagttacattcctgccactgtttacttcatgacctcatgtggacctacagttgggaagtggggtgacaacagaggaagggcatgtcagatgccttgccctgaaagtgctccctaactggtgttagaaggcaggactcgtcataggatagcagtgggcaaatcaggtagaatggggccgcagaatcagagagcagtgtgaaactgcccatgtcctgagaacccgttcccaatcaaagagtatgggtcctcactgaggacagcagacttccctgcaggagctgcctgagggtggaggcaggtgtgtacaaggtttgcatctggggtgggccctcttgcactgaacttttataggaagggagtgggagagcccagctggtctggaggccaggtcaagggagatttgatggtggtggtgtggatagacatttcaggctgcctcagccttgctggtacaagtgctggaaaatggagagaaatttgggtttgccaccccgggttggaacaggccggcagactgccaaagctctttggaggtagactctgtggccttcctttgcccctacggaaagctcagtctacagagctggccctttttccttccctcccctagtcgcctgggccctgcctgggtgctaatgggaaatccccagggatacaagtctctccctgcttcctctaatccagggccaactggaacttctgcggagactcttcacagaggccctctatgaggaagcagtcagccaggtgagtgaggagagggtgggaccagtggcctccttgttactccagctctccaggagcaatcaggtcatcatctcctactgggacagctgagccaaagccgacttggtcttctggagttcagatgagcctgactcacagaaggcttcccaaacagagagtccaattggaagaaaagtcagtggctgtaatgagcactcatctcttttttccccccacagtggttcactccagatggattccggtctctctttgctcttgttgggaccaatggccaaggaatcgggaccaggttagaatgttccagagctattgaagttactctcaggggtgggaaactgaggaaggtagccacagttcctttcaagactgggatggggtagggtgggactctggacagatcactgaactggacacagtggtgggaatcagaatgaggcattggaatctgttttggggagcctctgttggggaagatgggcccccacctggagaatgaagtggggtggggatgggagacccttcttcctgggcttaacttacctggaggtggagagccctgtgacctgggcttctgcctccccaaccatgggctgcctgggaccccccagctccctaagccagtgggtccatgcctgtgacactctggagttgaagcctcaggaccgtgagcagcttgacgccttcattgaccagctatacaaggacatcgaggcaggttggtgagatagggccttggcctcacccagccatggcgacccccccagtcagatggtggacacaaagtctttccccagggtgctctgaattaatggtgggggaaggtaatccctttgtgcctgtggggagcttcagatctgtccacagggcacacaggtgagaaacagccccaagatgtatccagaggcttgatgctgggaggaggggggtgctggataaataggatgtcttgtagacagaaaagcaaggcttctgtctcggagaggcaagtttaggtaagatggtagggactgatgccttagtgtggtggggttgcaggacagtggagacagtgcctgtccgtgtaagcctcgtttccttttcctgcctttaaaaatgggtagaataatgtgtgtgtattactgtcttacagcaactggagagtttcttaactgtgaaggatctggcctctttgtgcttcagagctgctgtgagtcatggcgttgaggagggatggtcccaggcgcttctgcctttgccaggtggccttgcagccacagtttatctttctcagttggccctttctaggctggtagggttgagtctgggagccccattaggtctgagctcccacaggaattcccctgggcctttttgttctatcatttttttcatttgttcatccaactgtttgtgctataatacctgcttatatataaaaccttacaataggccaggccctgtactaaggcaggcatagagctctgattcttgcaaagggatgcatgggctttgcaccgtcactgccttgtgagatttgggagtactgggagcccaggctacagggcgagtctcatcagcacctgatgagaaggggcagattcagctcagacaactgccttttccagacctcagcttcccaccccctggtttcctcactgcaaactcctcctcccaggctccagggccactctaccctcccaaactggattctcagagggcctgtgtcagctgttactagatgtccaatagcaggcagaactgagttaagtggtctggggtgggcattccttcagagccctgtccctccctttgcgagacagtgggaacacgactgagaatgaagttggccagtcacagcgagttggagtgggagtgctgtggagttcatttgtgctgtgctatatggtcttcaggaaagaacactggatgcagagtccagaaacttgggttccaaaacgtgctcagccttggcagggatgaacgagcaagaaaggacccagtgctctgcagaattgaggctattattttttttagtcaataatcctcattacctgcctcttatgatccaggcaaccacagttgtgtgcccaatgcagagacctcctttccagaaaacaacttccttttgcatgtcactgctctggaggatattaagccaggagaggtgagggggaccaggaaccgtcgggatgggtgggcagtaggccttggaagttctctgcagggatcaggagcagcagtggctagagcaccttgaagttcaggctgttgggtggaatccccacataccttagggtctgagtctttcagctcatggttaggttctaaccctacctcgctttttcaaaatatgactccagaaagcctcaggacagtgtttgagggacacctatgtgctcagattcttgtccccagctatcttttggtcaaatgcagatatgtaatttctaagaaagcaggagatagctctttgtgggtttagggtcttgtctgttagtgcaggcacagtgcctggttgaatcttcttgagggcaagtagcatcataccaagacctctgatcccagctgcagaccttggccattgactggctttcaccacggcctgaggccaaccagtctcctctgtctcaggcacaggctgttggagccttatagtggcctgcctactgaaggcactgggaactggatgagggcagccagccccttcactgaagggcaacgcaaacttggctcctagagatggggcagtggttggagatagggtagctgttggggaggtccttatgccatttaaaagagcacagaccatcagactgcacttctctgccctacaggaaatttgtatcagctacttggactgctgtcagcgggagcgcagccgccacagccgccacaagatcctcaggtgccagctggggacatggttgtgcagctgggctctggggtcctctacccatagctccctgacttttccccctcaccatcccccaccgctgcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaacccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgagaggcc

SEQ ID NO: 37265 - DNA, 69955 bp, Homo sapiens
gcccaccgcccgcccgccagccgagaagccgggctggcgcgctcggtttctccgcgaaagccggccgtgtacctaggaattaaccggcccgcgcgggagggaaggggaggggagcgggaagcgggaagcggggcgggggggggatgctgagcgcgcgcgagaacaataataagatcgtgtttgcggtcgctgcccgagaaggaattcggagcagacgcgaggcccggcgctcgcgccgcgcccgggagcccgggagggagaccggcagcggcggcatgaggcaggcgacgcggcgctggtgagcagcgcgcgcggcggcggcggcggcggcggcggggaccttggcgcggccggacgcgggcgagcgccgaacggccgggggctcccctcccccgctgccgggccgtgatttgccgggcctgctgcgccccccgcccaccccttgcctcagccgccgcctcgccgcttcccctcgtcggagcggccgctcgtccgcccggcttgaggcccgcggggagcgcggcgcaattcgtcggcccgcgggggggcggcctcccggcatcttcgcggcgaccaaggactaccaggaaggggagcggctgggatggcgcgtccgcggccccgcgagtacaaagcgggcgacctggtcttcgccaagatgaagggctacccgcactggccggcccgggtgagtaccgcggccgcgcgcgggcccgcccgcccaccattttccccttcatgatggcgcgcccgccccctttccccatcgcctcagccccgagcccgcagctcgcggccggctgtggtgagggctgagggcggcgcggcacgaagaagaccgggccggggctgaggcaagggctcccggcctcgcccgcactccgccagggcggccatccttccgcccactttcgaaggcgggtccggcccccgcaggcccgacgctgccttcctcctggaaagccggtgccgaccgggaagccacgccgccgggcagcgggcctgcgacggaggcttcggctccgggcagggtcattggtggataccctgggtcccgggcgaacgtcggggcaggtacggcagcggggtgagcggctgtccgcgagccggcgagtgccggcgggcagtaaatcctggaaagtggtagtggtcatccagaggccagcgggagcctcttggcagtcattcatccatctctttgccttctagacttgttgagttttccctgagcgcgattcccggtgccccgcctgccctatcattgtcctggggtacgtgcctctctggtgcccatcgttcttttaaaccgacctctgatagccgagagcttgcagcctacctctgactggtgggtccagcaagcttcttgtgcctttccacctccatatttgttttaggtagaatctcaaaccttattcttggcctcctgctacagtccacaatagctctctcttcctacataacaaggttgtcgttgggctctttttctagaaagcgtctgcatgtaatacatagcattcacaatttttattaagctctttgaggaagacacacaacactgccatgtgtgctttgtgttttagaagaaatcctttttatttttatttttgtatggttggcagttgattgcttgaaataagaaatcttgtgaaaaggagggtcaaggcattctagagattatattggtattctttaggaacggaaacagtcatggagaaaattggcataaatatagtgtgagctctaaaatgttgtattgtagtcaagtgaagatagcaagatcaagaaaaaaaaatacacccattcacaaaaggaagtgacatcacgagtggccagactgaaatttagtgaagttgaagtaatggatggacataatcactttttaaatatttggtttggcatgattgtcaaatggaaagaacactaggccaggaattgggggacctggtgtctggttcaggctctgttatggactaatcatttcaactgtctgcatatccattgctgcaactataaaatcatctctaggatcctttccaacactaacaacctcagatatcaagaggaaaaaacagtcttattcaggttccagtagactgaaaatagcttcgcatctgaactgtagattgtccttaagataaggcaaagtttttaaggtagaataactggttattttttatgctgtaatacagtattgcttagagaggcaagatttgtgactttaggagtccctgaatatatttgtgacttcagaaaatccccgaatctgtttgccaagtaagaaatgtatagctttagggccatatgtgtataaacacagtcaaagccaattaaaggttaccgttactagttggtcatttcctagtaccataatggctttttaaaatcttccctttgaaaaatatcttctgatagtcaaaaagaaaatagacttaaaatttcattaatatgttgcctgtacaggttggccacctgtagtaatttgtgaaacagaaaaatcctacggaagtggtcctagttgtatatctaattgtacataaaattcctggaagtgataattccaaataaggcaaaatggaaaataaaatgaggaaacaaaattaagtttttagataaaataggtacaagaaagaaaaatctgtatctattcacatttaacgagctcctcaagaaacaacctaagactcaaaaaaagaagttttattttctcgttagtggcatgctgcaatttccaaaggtaaaggttagaaaaagatttgagtccccttttttacagtgcgtatacttcacatatgttttcatttttttcatcccaattctatgaggcattattcccatcttacacctaggtatagctgtgtagatgataatgttataaaatgctaactgggaaaaaaagtcttgcttattgaagtttcaaatattatcacttgatacgaaggccattcatgtgggcattagatactgtggggcgccaaggactcaaacttaggagggaaaccaggaagaaacagatttcagagtacatgttgtaggaaggcactttgtattagagctggttcatacaggaatggagaagcaacttccttgctctagggaagatgtttggtcctaggcagccctttgtgaggaatgtaggtcaagaggattcagaattcctacaggttggattcagctcttggctgggcttcacactgtgaccttgtgcatgttctgtaatctttctaagtttctgtttactcgtctgtaaaataaagataattctcacctcacaaatacagagtatctaaaagcaccaagtgatggtacttgtatgttcctacctttttcctttttgaatttctaactttcctttgtatcactacactattttaaattattgtcaactttcaactcagatttatttttccaatattttatcctgaaaaatttcgaatatatagataagtttaaaaaattgaactgtgaagacccatttatctacacctagattctacaattaaatttcattctacttgctctttcatgcatctgttcatatatcctccctctatctacataatagttcctcttattttaatgcatttcaaggtaagttgcacacatcgccataatttactcctagacacatgcatgccattaacctagtggttaatactttgaatggatccttttctcttttgaggtaaaatttacatggaatggaatgtacttaccttaactgtaccattcggtgagtttgacaaatgtatacattggtataatataaatatagctctctatatgatatatgtctgatatatataagtatatgtgatacatatatataatataaatacataaatacattgacataatacctaccaaggtatagaacagtgcctacgaaagtactctcatgcctctttctggtagattcctgtcctcctccttccttctcccccattgttcagatgtattattctaacattaaatagcagctggctgtttctcatctagtatgcctaattttgtgtggctttaaaaattagaagttcatctatgttatggattagctagcttaatgttaaaaagtactgaggctaaaacgagtctctgatcgcttttgtttgtgtaccctgttggtaaaataatttgagcatacatcactaatatatctaaattttctttatatatacatgtgctttctgttactactatatacagcataaaataaacacaaaaagaaactaaaagggatgacatgatgaaaacaatatgttttaaaattttcattgcacaatatcgttaacagtaataatacttattattacttataggttaagttcatattttttaaagtcttaatttttggaatattttctgcctgcttcttgtgagatttgactagatggatggtcattgttcttaacttccgaagagattttctagaatagaagtgtcagcttagacatttaccttgttgtttgcttgcatctacattactaatattatttttgtgtaggaatctttcttttttttagccacctgttcatttggtgagagctagttcagttagaagtagatattccataatcctgctcaaccgggcacacaccaaatggcagtaaatcacagtatactcaacgtgaataaacataaccatctgaataagaatactattaatagtgtcaacttgcatataaaatactagtaaaatttactttttagctaaaagagtaagaaactgaaatcaaaattctgttttcttcccataccccacccaaaccttccgctgagatgtgagcactctgcttatgttaccccctactctaaaaggtcagaaaacaatgtaaacgaaaagcctcaaaattattgtgctttaactaaagcacttttttacacttaaaaactttatatgagaattatcaaatattgctagtagagtgtattgatagttacttaagaaaactgacttaatctacatatgcttaccttgtgacctagcagtctcttctaggcatatacccaagagaaatgagtgtttatattcaccaaaatactgtacaagaatgctcatacataacaactttcttcatgatagaacaggaaacaacccaaatgtccatcagcaggagaatgagtaaacaaatttgtagtatattcacatagtggagtactatttgacaataaaaaggaataaattactgatacagtggtcactggtttgtagtgggtagaaaggagttattgaataggagaaggcactggaaatgttccctgtcttgatctggatggtgttacatggatgtgtacatatgtaaaaatgtatcaagctgtacatttaagatttgtgcactatactgtatgaaagttatacctcaatttaaaaaacacattttatatgagttagggagaaaggagaactaatacttctacatggattaaatttcactatttttagctttcagtgagttgttttttttccttcgagtcctcactcctaccaagctgcatcttcctattcccttttgacttattatagaaacttcattttctactttagagcattctctttagactttctttgagttctggtttcagcctgtctggtttgtttacctgcatcagtgtctttctcttcctttaatattaaatcactgcttatcatatttttgatctagctttctttaacctctcactttgtaaagcataagaataaagcatttgaccttcctatttatatagcttcaagagctgagctcttactgaacttttgttgagcacctactgtatgtaaggcacaggggtatagttttttcatatctctagcaatagattaaatttgcagcaattctaaaacatgattatgaagtgtttccataccctttattaatataaatatttgttgggaatcttccttttctgatccatagcactttcaggttttttgcatttgacaatgatctactaagaaggtgataaatttatttctggagaccaggccacattattttcagagaatcatttgggacttaagttctttttaatctcaacataaagtaaggtgtttataatcttcattactttggcctaagaagtacatcagttgttcagtcctggcacaagctcactcagtctttttcccagggactactttcactttgccaaggatttggcaaattgtctcattttctcccacttaatctgggagctcataggaactttaaacttttgataccaatatgttcattttccgatgctcccgtttcaaccagatgagtctctattcctggcacatcccctttggaattctctaatgactactgttcctccatgatttggaaaataatattaattctcggaagtcagttttctactattagagattgtatttgattcttttgggaaatgactgatggtttaaaattatgtacaacttcattgaaaagcctgtttgcattagaaaagtattataggcttgtaagtataataaatatagtaggagactagcccgaatatatttatttattggagaaagctttctgtttcaaaagtctcagatgttagatcagaatccatcccacttgatgtagttattcatccactacaaaaaggtgttctaatcacttgcagtgctactgaaagcatgtcctgtgaatgttacttgtcagtgacaaaataggtacagaaattgaaataagagtttagaaatttttagagccgtttgatggagtagctttgtgaatctaataattgaggcttacattttgtatgtctttatttttctcataatttatttttattttataaacatgtctgtttgcaactcattagaactttaaaaaaaaaaactagtcattcactctaggtagagtagaagtactgactatgaaggatctttaaaggtcaatagtggtcctaatacgtaaaataatttgctcatatggtgtatttaaactattggcaactatgtaaaagggggaatgggttgaccttcatgttacaaatattaatttctcctgcataaaagtaccctcattgaaatagaggatagagattataaattatttttttctgtcttctttttacctagataagaatttaccacatttagtctggtaaataaccatctgtatggtcacagagagccacacagaagtgaaaaaaaaaaaaaaaaaaagaataaagtaatctaatgattggtgagcacaagccttcagaatgacatcctccagatttctgaggaagtcctgcaatgaagagaaagagaatcagaccaggggttaaaagacaagtacttcattccactactatcttggtttgttaggctgggcatcttttttattgtgaacctctttgtaaaataggatggatgataattcttactctttcccttctttttcctaaggatcaaatgttaaaatgtatatgaaagaactatttgctaattaagttccaattaagttactaaataattatctcccaagaacacaaagcttcttacttatacaatgcagggaacgtagtaaagtctcagtaaatgcttctgtggtttggaaggtatgtttttcagcagctgctttgtggctttataatagtgagttggctctagactctgggaatttggggacttcccattgttacccatcttgatttctgagtgtgataggccatttcttttttttctttcttttttttttttgagatggagtcttgctctgtcatgaaggctggagtgcagtggcgggatctccgctcactgcaagctccgcctcccgggttcctgcctcagcctcccgagtagctaggactacaggtgcccaccaccacgctgggctgatttttttgtatttttttagtagagatggggtttcactgtgttagccaggatggtctcaatctcctgacctcgtgatctgcctgcctcggcctctcaaagtgctgggattacaggtgtaagccaccacacctggcctttttttttttttttttgagatggagtttcgctttgtcgcccaggctggagtgcagtggggcgatctcggctcactgcatcctctgcctcctgagtttaagcaattctctgcctcagtctcctgagtagctgagattacaggtgcccaccaccatgcccggctaattttttttttgtatttttagtagagactgggttttactatctaggccaggctgatcttgaactcctgacctcgtgatccacccgcctcggcctcccaaagtgctgggattacaggtgtgagcccctgcacctggcttgtgataggccatttctggaagttccacagagcttcaggatttggggacaagataaactggaccacattaacatacaaaaagggtctaagaataaactattcttctcatttgatcattgaaactcatattctgaatagattctctaagtctgaatatagagtctatacagctacccagaagtagaggtgtcagtgtaggggagtcagtggtagctgccaggttgcctgtatggggactggaaaatttctgatcacatagtaataacttctcagtttctattgcaaaatacgagatgagagtggttttaagtgatagtttcagtagtggttagcacatataaaaatgagtttcacagaagattaaggattttttatgatgtagacaggtcagaaaataaactcaacttcagatctctatttccttttcctttgacactgaagtagtactttattattaataacatgtttgatcttggaggaaatgcttgttcagagggagtagtagtataaattctcagttaatgcttttagagttaccatatgttgaatggattgaaaattccctctagaccactatttgatgttccaaatgaaaccaactaatttaaaacaagttataacttctcttatctccttccctggactactacatgatgatgaagtcaataattttgaaaaaaatatttagactttggaaatgagttgttgttgctgattgattgcagtctaacggctttcaggttttttgactgtaacctacagtgagaaataaatattaattcccatcccagtacgtgcacatgcatgcacacacacactgctgagatttttatatgatccgtttgtcccctccaaaactcatgttgaaattttatccccagtgtggtggtgttgggaggtgggttctagcgagaggtgtttgggtactgttgctggtcctgtggtagtgagttctccctctctggagactagattagttctctgagaatagattagttcttgcaagagtgagttataaagcaagtttcttcctcctgtttggttgcttttcacgtgtccactttccctttgaccttctttgccatgttttgagttagcacgtggcccttaccagaagctgagcagatgctggtaccatgcttatactttccagcctgcagaaccatgagctaaataaagcctgttttctttataaattacccagcctcatttattctgttacagcaacccaaaatggactaagatgcacctataacaaaaaaattttcaagttgtacttactatatgtgatacattctgatatttttatatttcattttatgtaaagtcaggttgcaacctgctaaatgagtttcattacctacagtttgaaaaacactggtctggtcagtaggccaaagggaaagtaatctctgtgagttgtatgcgtttatatagaacagaagttggatttttgagaggatgatttgttaacagtcctgagctttttattctgctgtagccacagtcttacatgaaggtcacacgaacataaattaaagcaatagtgtattaggtcattgaactatccaggccaatatgtcccctgatcccaaaaggttagttatatagattttaattctcatcttccttttaatctttcaactgcaaatgtatcaacaactatatatataattaattggcttcttttttttttttttttttttgagacggagtctctctctgtcaccccaggctggagtgcagtagtgtgttcttggctcactgcaagctctaccaccctcctcatcaccccctccccgccgcccccaggttctcctgcctcagcctcccaattagctgggattacaggcgcacaccaccacacccggctaattttttagatgtttagtagagatggggttttgccatgttgggcaggctggtctcgaactcccaaagtgctgggattacaggcgtgagccaccgtgcccggcctataattgacttcttaaaggtagtaagttccacacgtttgctgactaccgagttatatacagtgtttgacaaactagtgttccgtggctgatgatattgaggctgtggagttttcctggtttgtgggactagactgtggaggtatcaagctatgactgaagatgatgagcttttgtgaagttcagaaacttgaagatagggcaggtttgtggtaccctttaaagtggatgtaaagtttttgcgattaacatgtttctaatggttttgtatttcctttttaattattttgtcctatcaaaaagagattgccttgctactgtgagatatagcaatctgagtagagagaacctggtattgatgataggaaggcattcttcaattttttaaaagaaacatttctgaaaagttactgtaagcacagttttatgtcttacatctggctcactgactcacataaaatatgtaaaatgttattagaaacagacccactatactattataaatggaaatattttgaagtaaaagaaataagattagattaaattttatgatatgccaggtgttcaagaactctggctgttctccagctcagcactgaccctatcttatgctatgtgtgatgtcaggggaaggacaaagcctttggtagagttatgaaatatcatggtctccattcttcgttttgagtacactcctgggataaagatttatttaactacaaaggatcaggtaacccagaacaaatgtgtcccttatttttatattgtaaaagcaaatgacaaaagtagtgcagcttaacaagagtgggcatgccctaggtcagctccttgtacatcttcctcagatgttagtagatacatttactattctcttccagcctttccccctcattttcagcaaattgttttaccttcatacttcatagagaaaatagatgccaacaggctttaactgcaccttcctatcttttgcttataaatgaaaatcatctctctctaaccttctctaatcctcttggatttttgtttcccccttttttgttaatcaattctatttttttctctaaatcattaatttctgatctcatcttcactacctttccccaagtatatttttcttttcttctatttcaaacttaatgaaataaagtcttatttaatttttttgaaatctttttgaaaatgaaaacttttaaagctagttttcctcaggtcatatttggcttcatgatgtagatttgaataattggtgttttatagtcattttcaaaataggttttgtgattttcatttctgagttggcccaagagatatttaggagagaattttaggaattataactggctaaagagtttgtatgtaatgctttattgttttttaatatggttatcttgtagtcagattatgtatcctttttaactattttaattcatttagtgttcttttcatatgtgatcaacttttaaaaaatggtttttgtattcctgaaaagaaagcttctttaggagtcaataagtatattgacttaataaatgagtcaataagtatattgacttaataaataagtcaataaatataatggacaaatataaatatattgatatttactaatatattttttaaaattcttaatgtttattttttgtcaactactctctccaaaatgaagaggtatataaatctaacatatctattatatttctacatatctgtccctttttttgaccgtttatttaataaatgtcagggctttatttggcacataaatgtgtataacttgtaacttcaggatggagtcaaaatatagtgatctgctatttcatactttctagcacataagttatagtacttcgttggatattagttttgtaacctgttttcatttttgcttttatttcactaatacatctttatccagaattttactcaaaacttttctgttttgttttaagatataagtatatgtaacttaatttttttaaccattcctaggagatttttttcccttttttcattctttgccaaattttgtaagaacctggttttcagcatttaagcatataacattcttaatttctgtcattgaaacttttactttttaaattttcagttatttccatgtgaaggtagaactacgtgaattgggtaacattaatgttctaccattataatctcattaggtgtttattgagtatctcttctgggttagtaactgtgatagacttagcattataaaaattaataagacatgattttaacattaaagagcttgagatagattaaggaacagaaacatgtacatagaggaatacaagtgcaatatatgtagatctcgatgacaatatttttcttttatttttttaaaaagacacatttattcagtatcatgatcagactattacatttagcaatcaacagcatgggtgcaaaaaaaaatctacattaaaaaacctttgttggaatgttttacactttccacataacagaaactaaaataacctgttatacaattagtcacaaatacaatcctcaagttttttgcccaatatttgtctgaaacatgatgacaggatttttctatctttgcaattagactaaatgaacaagaatgagccaaaactgactaagaaagagcgtggaaaagagaatacatggagacatttttaattggcaatttattacaaaaagactgggtttcagctttttttgtcatacgatattgaaatgtagtttttggaactgtctacattatttgtaatacaactatatagtcttaccattagaaagagataacactgcatcctgagtgagccctcctttacattttgttctattgctttttccttccctgcaggcaatttcaaagtctttaatgaaaatttaaatgatagtaccttctgagacataagatttaagatgattttcagtgttgttttcgaagggatgagaaagctaaaatgcattaatctcttttaccaactgacttgctcagttacagagcaagtaagtggaagggagctgcactaaaattcattgccgtctgcacccatctccataggatgccaggaggaagtgaaaggagataaggaattcacactaaccactttgacaattaggcagaaaccctgaatttattttaggtaaagaaaaggtgaaaaccagacttggaataagctttttatgtgctcattgtaattaaaaaaaaattttaattgtaaaaatacatagaatgtaatttataccatcttaataatcattttaagtgtatagtttatgtaatattaagtacattgttttgtaaccatcaccactctctatctccagaactcttttcatcttgcaaaacaaactatacccattaaaaaataactctacattccctgcctcctagtccctggcaatcacctctccactttgtgtctctatgagtgggctactctgggtacctcatacagatggaattatacggtatgtgtttttttgtgactggcttatttcacttagcataatatccttgaggctcatgtatgtccaaattttcttcctttttgagactgaataacatcccattgtgtatatgtaaaacattttgtttattcatccactgatggatacctgagtttttttcaccttttggttattgtgaatgatgctgttatgaacatgaatgtacaactatctcttaaagaccctacattctgttctttggagtaggtagccagaagttgaattccttgttcatattgatgcaggacaggtgagcccccaaattggggcttagcttgggagggttcttggctttgcccaggaaagaattcatgggtggggtggtggtggtgtgagtcagcaactcttattaacgtggcagcgtatagcagcagcagcacaggtactgccccatgcagagtgcagctacactataggctaccctgtaggcagtgtacccagagtagcagttcaggggcagttctgcagtcatgtttatatccacttttaattacatggaaattaagggacagattatgcagaaattcctagaaaaaggattgtaacttctgggtcattgtgtccttgccatggaaaggggcaataacttccagatgttgtgctggcaacggtaaattgacatggcactggtaggtgtgtcctacggagagttgctttcatatttttcctgtttctgctagtcttcaatctggtccagggtctaagccctgccttctacttcaatatggtaattgtatttgtaatattttgaggaaacaccgtactgttttccatagggactgcaccattttacattctcaccaacaatgcacaagggttccaatttctttacttcctcgccgatgcttattttctgttttttttcaaagtaggaatcctaatgggtgtgaggtggtatcttatggttttgacttgcacttccttaatgagcagtaatgttgggcatcttttcgtgtgcttattggccatttgtatgtcttctttggaataatgtctattgtccttcacccattttttaatcagcaaaaaatggtggttgttgttgagttgtaggacttaatcatatgttctggttgttagcttcttaggagatctatgatttgcaaataattttctcccattgcacggattgcttttttttactcttgatttttgtgcttattgtaatttattcaaataagcagagaacgggactctggaagagatgtcccatgacagtgagtttttatggaagtccatatgtggtaaaggcaggagcaatgaagtaaggtcctgtggtgacatggcgttacatggaatagaacaggagaggaagttactggaagataaagagctaagactaaagacaaacctcagaagtttgcccaggcctgtccttaaatgaggcaattggttagaattgagaacaaagaaagtaagatagtgttcagaaaatgcctgtgtttgattatttaaatgattgaatcagatgttgtacatatagggtggtcaagatggattggttgtgctaccacttttatttgtttttaaaacaggcatatcttaagactcaaaaaacccaaaacttaagattttgttttatgcctaggatttttcaaattttcctgtgatgaatttcatccttgagacataaactgaaggagattatttctgaaaaaattatccaaaaaatgctgtcttttctggacatttatgttcccacaaccaagtcttaacctgtacttatggaaatattacaattagctcattcatcgtgccttttttcttattttattgggaactacattgactcatcaaaaattaatgttagcttcctaatcaaagtactcaccatgtctgctctcttaactgtggcatatattggtattttcttcctactgtttgctttccataattaaatgtttgtttagcaaccctgtcaggagtgcatgtctatcaaaatttgttttgttttgttttttatttttagattggaacttttggcagaaagtcaaaactgtcttcatatctgtatccttagaaagaggtgagttacaggtcaggcactgtggctcatgcctgtaatcccagcactttgggaggccgaggcaggtggatcacctgaggtcaggagttcgagaccagcctggccaacatggtgaaaccccacctctacaaaaatacaaaaaattagccaggcgtggtggcaggcatctctaaccccagctacttgggaggctgaggcaggagaattgcttgaacctgggagacaggggttgcagtgagctgggattgcactattgcattccagcctgggtgacaagagcgaaactctgtctcaaaaaaaaaaaaaaaaaaaaaaaggagagataagttacaataggatgcatttaacagatggttcaaaatccttacaatgttattaatgctaccataggttaagtttttgagacatttgatggattatcatgcttgtgcttggattcggtgatttttgccttttgtctggtatcagtctaggatatacatccaaagataacaagcagaagaatcaatgttactgaaaataagttagccaaataaatgacagactttgaggaacatatccagagtataataaaagaaagttttcctcaccttaataacagacatagttggaaattgacaaggtttataacatgttagattccaagacatactttagttaaagtcttaaacttacaattttatatgtttccaataaaaaattgggacaaacagaattagcttgttgagattcacaattaactgttggaatttggattatatctttggattagtatgggaagaattgacatcttagaatattgaggcttctaatccatgactgtggcttatttttatatttatttaggccttcttaaatgttttaaaattgttttgtaattttctgtacatatattttaggtatattcttaggtatcttttagtccttgctgattttataaatgcgtgtttaattgtgttttctttttatttctgttctttcaaatgcatgtataaagacagccaaaacaagacatttctgaacaaggagaataaggtggtgagacttgtcctatcagttatcaacacacagaattgttcaaatagtaattaacagtaaattaagaccgcttttggctcagggagagatgtattaaccagcagaatagaaagtgaatacagaaaccggcccacagatagatggaattcttgatatggaattcaagatcaaggggaggaaaggagaaacttttttaaaaacactgatatgattagttatccatataggttaaatatccatatgggttaactttcatagtatccatatgaaattagatccttaattcacaccatgtacaaaaatcgtttctacatagataaaagtgtggaaggctttcagggcctgtgggaaaatatcattgtgtccctggagtaaggaagaatttcctgacaagacatagaaagaactagccataacaggaaagattaataaaattgtgtacattaaaatcaagtgcttttgttcactgaaaaactctataatgaaattgaaaagataagccacaaaatgggagaagatgcttaccatacatagaaccaataaagctttagtatacaaaatgagtcagtaagaaaaagacaaaagctcaatgggaaaatgggcaaaagacatgaacagccatttcatagaaaaaatacataaggcctataaatatatgaaaagatgctctgcctcataagtaatcgggaaatgcaaagtaagatcaatatgagactgccaaaaattaaaaggtttgccagtatcatatgttaaagaggatatgggtgaacagaaactcttatacaatactgaagaagtatatactggtccaacccctttggaaaacaatttcactttatgttgtaaagttggattttgcatactttctgacttagcatctctaatcctagttgtacactctagagaaatacatataacagaagatatgtacaagaattttacaacaacaggattcataatggtgaacaaaatttggaaatgagcaagcttttttttttttttttttgagacagagttcagctctgttgcccaggctggagtatagtggcacaatcatggctcactgcaggctcccaagctcaagcaatcctcttaccgcagactctgtgcctaagtagctaggactacaggcacacaccaccacacccagctaatttttttgttttgttttgtagagatgaggtctcactatgttgcccaggctggtcttgagctcctgggctcaagcaatgatcccacattggcctcccaaagtgctggaatcatagaacccaagctttttgatggaggatgaaaagttaaattgtagtgtattgacataacaggatattatgccgcattaaatatgaatgagctacagctatacattggttgctttcaatgtagttaatcagagtacctttgcaattatcagtgtcaaaaataataaagcaatatttacccattattttaaaaaaaatgattgaattcccactgtatgccagattactgttctgagtgccagggatttaacagtgaacaagaaggacacatcttctgtcttcatgaagcttatattttagtttagagggggagatatgaattagtaagcaagcagagtaatatgtaatttaatgtagccaggaaaggtatggaaaaagatgaagcaaagtaagaggctagcatgtatgtgatgtgtgtgtttctgtataataaaggaagacttctgtgaaaatgtgacacttcagcagagttggatgttctgaggaaaaagtaggaatgagctcagcataatcaaggaaaagcaagaaggcaaatgaggcgcagagtgagcgagctaggacctgggggagaaggacagaagatgaattcaggtaggtagacaaagccatatcatgtaaggccttatagtttagtaacaagtttagagtttttaaagtaggatggaaagtcataggagagttttaagcaggggaattacatgatctgatttatattcagggactgaagaattgattgttgggggcaaagggaggggtggagtaggggaaggtagattcaaagggcccagttggtaggctttcatagaagtttggatgatagtggagtagatagggatggggtagagtagcagtggatgtagaaagaagtggttagtttggtgacatgttttggggtataattgaaggacacagtgatgaatgagatatgtctgtgagggggaggaataaatcaataatgaattccaggttctggtaagggcatctgggtggatggtgacgccctttactcacatggagaatcttgaaagctaagtagattaggccacaagatgttaagagttcattttagaaatgccagtgagacacccaatatgtgagtctgaagctcatatgagaggtctggagtttgaagatagaaatatgagactcatcaacatacaggtggcatttaaaaccatagaaccagatgaaatcaccaagggagtaagtaagtgtaggtaggtagagaagagaagaggggctatgaaaggagactcataagaagtggatggtaagatagggaaaaagtatattacgagactatggcatcctggaatccgagaagaaaatacgtcaatggatacattacataatgaataaatatgcagtggaaattgtacatatcagatgagtatattatacattaatagttgtttttaaaaaatactgtaatcccaggttttgggaggccaaggtaggcggatcatctgaggtcaggagttcaacctggccaacaatggtgaaaccccatctctaccaaaacatacaaaaattagctgggtatagtggtggtgcacacctgtagtcccagctactcaggaggctgaggcgcgagaattgcttgaaccagcaggcagaggttgcagtgtgctgagatcaccactgccctccagcctgggcgacagagtgaaaccctgtctcaaaaaattaaataaaaataaataaccctgtagggaaatgcagaaatgatattaataggcagttcactgaaaggcaaatcttgatggccagtaaacttatgaaaagatgcttaacctcaccattaatgagggaaatacaaatttaaaagagcaataatgtctaatgctgtcaaagattggaagggaagtcattttcatactttggttgaaatgtaaattattatagcctttaaaaaatatgttctggtaatatctgctaaaatggaaaatacctctaatctatgatccaacaatctcctcaaagtctatcccatgtaaatagaagcaccagtgcataaaaatgtgtgtttactgcaaccttttccttttttttttttttttttttgagacagagtttcgctcttgttgcccaggccagagtgcactggcacaatctcagctcactgcaacctcagcctcccaggtcaatcagttctcctgcctcagcctcccgagtagctgggattacaggcatgtgccaccatgtcgggctaattttgtatttttattggagacggggtttctccatgttggtcaggctggtctcgaactccggaccttaggtgatccgcccgcctcagcctcccaaagtgctgggattacaggcgtgagccaccacgcccggccactgcagcctttttctaaggagaaaagcactgaaaacaaggtaaatgcccatccctggggaaaggttaaataaattataggttatccaattgctgtattattatgcggccattaaaaacaaattaattaaatttatggcaattgactgcaaggacttttcatggtgcagagaattttataaagtatgattcctgtgtgtgtatttgtggtggtgtgtgtttgagagagagacacacacagagagtagttctccacacacacacacaaaaaaaaaactctgcccgtgtaacatttgtatatgattatgtatatgaacatggagaaaagcatactttgttataagtagtgattacctgaggaagagtaagtctgggggaagatttagcggtaagcctccacttactcaattaacaaacaaacaatgtctctgtttaaaaaaaaaaaaaaagaatttccaagaaaagtagcttctgtgacatacagcccatttatgtaaaatatatgtgtgtatatatatgacatgaaaagatagtcaccaaaatgagaatcctaaagtataactaattttttaaagtaaaatgctaatttgggatatattcatcaccattttttttctcctttcattgctggttcagatggagaatgctaatattgatcagataaatccaatttacagatagaataaagataattttgtttttaaaaaatgtatttatttacttatttttcaatatctttatggggtacaagtggttgttggttacatggatgcattatattgcggtaaagtctgggattttagtgcaccatcacctgagtatgcattgtacccagcaggtagtttttcatccctcgcccccctcccaccctcttcccttctgaatctccagtgtccattataccactctgtatgcctttgcgtactcatagtttagctctcactcataagtaagaacatgtagtatttggttttttattcttgagttacttcacttaaaataatggccttcggtttcatccaggttgctgtagaagatattatttcagaatacagaaaattttgaaataaatttaccggattactattttgtgctcttcattaacttctatttgaacatctatgttcttttgctgtcttagccttccatctttaaccagtagtttgagtataaactaaatgagacttagaatggaaattacaataggttaatatcaaatccataagcagctagtagtgttcagttgagcgataagtctaactgaatatctgaatcatgaacacacttgtctggtatctcctgctttgttcttgaactctttttgtagtttcttcagagctactccatattaattatattttgctgtataacaagttgctctaaaatttaatggcttaaaacaatacacatttagtcacgatttctgtgtttctggaatccaggcatggccgacctggatcctctggctctgggtctcccacaagggcagtcatcttaaggcttgtctagagagtagatccatcttcaagctcacttaagtagttgttgatgggattcagttcttcatgggttgttggcctaagggcctcatttcttcatgagatgttggccagagcctgccttaggcttcttgccatgtaggcttcatagaataactgacaacatggcagctggcttcctcagagcggacaagcaagagagcaagagtcagcaatatagaagtcatagttttttgtaacctaatcttagaagtggcatccaatcccctttgccatgttccattcattataagtaagtaactagatccagcacatactcaaggacaggggattttatgtaaggatatgaatatcaagagtggggatcacacaagccattttagaaacaacctgccacctccatcaccagtgttcctgggattatctcatcttcacttctcaatacaggcaaatgcatctctcttgaagtggtcactaaaactccctcttcccaggacatctcatggtatattttcagcttttttctgctatgatcctctcgcctccgggtagcctctttgacgggatttaagacaacctcacacagtctctagctgatggtctgtggaaaacttctttaccacaagaaactctgagagtgcaagccaatcccagtgcagtcacccatttcactgtgccatcagaccaactaaccagaaagttctgtgctcttaagatttcttgggcttgagtcaaataccagcattctatgacttctaggctcttgaagacttatcttaagctctccaagcagtcttcttaaagcttctaggccgggcacactttgggaggctgagacgggcagattgcctgaggtcaggagttcgagaccagcctggccaacatggtgaaaccctgtctctactaaaaatacaaaagttagctgggcgtggtggtgggcgccagtaatcccagctactcgggaggctgaggcaggagaattgcttgaacccgggaggcagaggttgcagtgagccgagattgtgccactgcactccagcctgggctacagagtgagactccgtctcaaaaaataaaaatttaaaaaaagggtgctgagacccacagcatacacatagcttttactaaaaattatctcctaataacctccaactctcctcttgccttctccaaaactgtttgttgttgtacgagagtgaaagtttacaagggtctttaccacattctttgcaagtctggtaatggttacccacctcttaatggaaatgtattatctgttgtcttggattttcccttgcaactgacgctcgagtagttccatattgacatctcatttcatctgccatttgccttcttcctgctctttttttgaagacatctgccctgggtagtttcctgaagttattgtagcaataaaagtgattacagtactacctaatatattaaaccaaacagtggaacctagtagagaagacggaggaaagattcataaagaatgggaaagggaaaggaagagaggaaagcactaagtaccttatttcagattagaatagataaaatattttataacagtaattatattattaacagtgattatattttataagttgttttgatagtgttcttgaaatatctaattatagaattaagaatgaggtgtctgaataccttattcatagaataaagataaacatgaagagagaaaacaagcataaaaagccagacatcatagtacaagcataaatggtttccttttggactgataaataaaatccaacaatatgttgcttataaaacactgacttaacacagatagcagaaggcaaaaattacctccaaattggaaagccctatttatcagacttgaataaaacaaagagttggcagtatttatgtaagagaaaacagaattcaagggtaaaaaagttgatatcgcatatcatttttgtgttaacaacttaaagccctctgaaattgacaccaaaaataaaagatgtgcccaaattggcacaactgttatgaactggatttacatgtatctgaatttagctttttgtacatgattatctttctttaaattttttggtgggagaggcaaggcttggaagatctgagtaaagcagtgaattcttttcccattaaaatgaaatatataaaatcttgcatataactagggaaattttgctggaggagggccagctaagagtcattattggggagatggcaaaggtaaggttaaagttctgcaaataaaggttcctagaaatttaaaccaggtttagaactggaaacccttaccaaactctctttgcagtgggaaaagatactttttttttttttttcttttttttgagatggagtctcactctgtcgcccaggctggagtgcattggcacaatctctgcttactgcactgcaacctccgcctccgcctcctgagttcaagcaattctgcctcaacctctgattacaggtgcgtgccaccacagtcagctaatttttgtatttttagtggagatgaggtttcaccatgttggccaggctgttctcgacttcctgacctctagtgatctgcctgccttggcctcccgaagtgcagggattacaggtgtgagccaccatgcccagccaaggtgctctttatattcaatcagacaaggttcttgttggttcagttttttgagggcctgttaaaggagaagttgtagacagcagggcacaataaatttaattgtccaattatttagcaataatttcactctacgatttttgtttttttgaatgacacttttttctggggcaggccttgtgcatgtatattattattggtttctttttgatttttatgtcatgggggtttggtgtacagattgttttgtcacccaggtaataaacatagtacccaatagctactactgtggtttcaatctgtacagggttttaaaaatcaacctcggcttgtaatgaagcacagtagtctcctgatttattgactagataatatctgttgactttacattttaagagaaaaggatatagccaatttgttaacactagtctcatcctcttcttccctctctatttatatcaacgtattattttgaaaatactcaaatatacacaaaagttgaatatcacggtgaacacccatacacccaagacctacattctatagttagcattttgctaaatttgttttatcacatttctgtccatctaacaatctctgttcatccatcaagctatcttattttttatgtattttaaagtgtaaattgcagacattaatttacttcatccctaaatacttcagcatgcatataactaactagagtttaatatttatttaaacttttgaggtaaaatttacatacagtgaatgcatagatcttaagtgttaaatttcatgagacctgtataaaatattaccattaccccagaaaattctctaatacccttcccaatctccagaggtaatcatactcagattttttttcaccatagatttgcttttccttttctagaacttaatataagtggaatcatccaatacgtactcttgtgtaagtcttctttcatttagcatagtgttttaaagattcattcatgttattgtatatattagtagtgttcccttgtatgaatatgccatagttggtttggccactttcattaggacacctgggctatttccagatttaggctattaggaataaagttgctatgaacaaccttgtacaaatctttgtgtggacataccttttcatttattttgagtaaatacataaagcattataacactttagtttgttaaaagatatccacagaagatactacttcatgcctactaaaatgactaaaatttaaagtaaatacataaagcattataacactttagtttgttaaaagatatccacagaagatactacttcatgcctactagaatgactaaaatttaaaagactagccataaaaagccataaaaagactatgagaaaagggaaatatctggtagagagtacagggaaaatgtctgagatgacttaaatgttctatacttgatttaggtatttgttatataggtatatgcatttatcacattaccaaataatgaaatacacatttaagatcaatgtattttactgcatttaagttttacctcaacaaaagtaaaaataaaccctaaaagcaagtgtgttttattttatgcctgttcaaaatagaatctatgtggacaatagctttgaagaccaaggaggattgtggaggaggagggtgcagcgttgggggaataagccagatcagacaactcaatttaaaatgtgactataagggccaggcatggtggctcacgcctgtaatcccagtacttcaggaggctgaggcgggcagatcacttggggtcaggcgttcaagaccagcctggccaacatagtgaaaccctttctctactaaaaatacaaaaattagccgggcgtggtggcacatgtctgtaatcccagctactcggaaggctgaggcaggagaaccacttgaacccaggaggcggaggctgcagtgagctgagatcgcacctctgcacttcagcctgggcaacagagtgagactccatctcaaaaaaaaagtgactacaagaattgaaaaggataaaccctggaggtttaaatgaagatcataaatcgaaatgcctcacttttaactattcgagctgtgttctttcagttgtcagagactacgcctctccccaggtatactatgaggctgagttaatgccccacatatattcttcctccagaatcagcagtgtaacatgctaatgagaaacctcagtaaatcatctggcccatcccctttatacagcctgcatacatcccctgtacatctgctatatacaacttagttaaaagcactaagttctaggtatatcatgacctctcaaaattatttataattattttaaagattaaaatgacaatgtttttagggttttattgggtgaaaaaatgtctgtagctataagattgttctatcactagtagatggtcgtttttatatatttgaagataactcagcctgatatttcatacattttttcaaactagtattttggaaggtgtttccatatcatcatgcttgcagttcttttaacagtgttcttttcaaatattaaattgccgggcatggtgattcacgcctgtaatcccagcactctcggaggccaaggtgggtggatcacttgaggtcaggagttcgagaccagcctagccaacatggcaaaaccctgtctctactaaaattagccggccatggtggtgtgtgcttgtaggcccagctacttgggaggttaaagcaggagaatcgcttgaacctgggaagtagaggttgcagtgagccgacatcatgccactccattccagcctgggcagcagagtgagactccgtctcaaaaaaaaaaaaaaaaaaaattgataagttacatgtttattaaaccaaacagactcttatttttaaaattctttcccctttctcctgtatgcatttcctttttcatactgtgattttcccttctgcccctatggtaaatttgttgactgatttgcagacttctctttatccaaatccatttttataacaacatcacatgttagggttttttccccttttctaatttaccacacctcataaactttttaatagctaaaatgtttttttctctacgttttttgtcagctagcccaaaaaattcttctcattggcatgctcagagacaagtttgcttgcccttcttccattcttttcttatgcatagagactcctttattctataacctcataataatttttcttagtaatttgttattgaacgttattccacaactctcctttctattccccaccacagcagggattatggattccctccatgtgtaaatgtgggcatcgtcagatccggagtcaatcaggacactttggtcttccctatttttttttttccttttccactattgaatcctgaaataaattcctcaggctaggtttggcatctactgtttcagctgtagtcttggatttccacccaccacctccctctgccccccgccacacacatacacaccccaagtgacaatccttatacttcactccttactttctccctttctctctttcccttcacacacaacacacacaaagagctggccaggcccataggactagacttataacatcatgcattcaagggatatttattatgcacctaccattttgtcaggtactgctttaggcagtagtgctacagggatgaacaagtcttcccctcatggagattactctaatgtcaagagacaaacatatactgaatattagagaaatgctaaaaataaaaatccatcagaataagggaatagaaaataatagggaaggaggtgctgcttcaagttaggttataaaggaagtatctctgatgagatgatatttaagcagagatttgattggactaaggaagtaggccttgagcactttcgagagaagaggctttgcctatggagaaccttggtatccttgcctagccctctggttcttaggacttctcacccccaactaccatctggactcctacaatgaacaaaaccactaagctaccacacatacaagtttgagccatgtggaatttccttgcctctgtttcctaattagattatcgtcatgttggtacctatctgtgttttaatcacctcctatttactctattggtaaaggagggattcccaccctgtggttataggcatggctgaacacacaacacccaacactggacagatgagacagacagcagtttattagttacatatactcacagctcaggagaggagggcactgcacgctacatgggccacatggaaattgcactccgaaacagaatgccccaccaggggcagtgggaggcaggttttgtagtatcaagagggtaaggtaccacctggttcctacaggagaatgtgattggcttatttgaataattctacagactggcaggaaactgaagcctgctacttggggataagtaggaactgtgcctgttctgtttgataaggagggtttttggctaggggtctttatctataggagataaataagagtagggaggagaacttgcagataggctctcctgacaagacaacactaatatcaagctttaggtcttacaccacagtagaagcctgatccatttcgcagtgaatactgtgaactcagtgacattggaagagttatcagagaagaattaatcactgatttaacgtaggagcatagacatctgagaataataaataatgaattaattgaaacaacaatataatgttttaaatagacatagaaaatggtaacccaatttttctaaaagaaacttagctctatgagaagtgaggaactttttttttcttctttattttttgagacagggtctcactctgtcacccaggctggaatgcaggcatggcttactgcagccttgacctcctgggctcaggcaatcctcccactgaagcctcctgtgtatctgggaccacaggcatgcaccaccacacctggctaattttattgttgttgtagagatggggtctgcctgtgttgcccggggtagaagcgaggaacttttgtttatttaaaaacaaacttaagagtatgacaagagtcaacacaaagttcaggaggttattctagtgaaatatatcatctctgctacttagattatttagagggtgaagagtaactcttactatatctttttaagatcagacagaattctccaagaccaattcattattttgacacagaaaacaaaattctagctttgtattaacaaatatttgacattagtagattcagaaactttccctttttaatcttatgaagaaattcattaaaactgagccaacttcagcaattttaatatttcattgtgtgttttcggactgttatttgcagttattatagttcaaagcaaatacattttcctttccacaaaccttcacagctttcagtattcatccaggttttgtccttcattatcctcttgcgcattttgaaagaaacccagatacttgatgaacaaaactaatcttttcccattaataaacaaaaatatatccatcatcttgcatatgcagttgatttctgtaccactattgtttttaatattatctcaatcttcatgttaattataacaaccaaagcaactagtttctgtttcacagagttaagtaactgagaaattatgtcatatgaaattgttgtagcaaaccagtaaagttcatgaacgtgcataatatacatattatacatcctttctatatcttcctaaagtgcaaaaatagccactacataacatataaaaattaaaagcagatacacacacacacactcagtgaccaatgtttttatatttctatcttaaaaattcaaatatgcaaagattatccattgattaacatgacaatgttagtgtagggtcttgaagctaactaggaatattagaaatgatgtttaatctaacaaactacagaacataattgctgttgaaattttttaaaagtgtgtcaatttgaagtttatattttgtaattcaagtttatatttttcttaatcattaaatggaagtaatactagcttaacagtggaccttatataagaagttcaaaaatgttatttgcgtctttatgagcaaacaacccaaatcttatttgaaaaataaaacatttgcttatattacacactccatggcaattaaattcagacaaggacaaataggtgttttaaaaccaaaaattcatcaaaccagtctgatttgttcaaggattcacttggattatttgaattttgattcttatataaaaatgcaaaatggctcacgcctgtaatcccagcacttcgggaggccgaggcggatggatcatttgaggtcaggagttcaagaccagcctggccaacatggtgaaatcctgtctctactaaaaatacaaaaaattagccaggcatagtgacacgtgcctgtaatcccagctacacaggcggctgaggcaggagaattgcttggacccaggagccggaggttgcagtgagctgagattgcaccactgtactcgagcctgggtgacagagcaagactctggggtttttaggataccacatttaatatagtgtagttctcctttaataaaaaataggaaatttgacattttgtactttttttttttaagaattagggaaaccaacttgcaccaatgcatttttgcaatctcagtgcaaaaatcctgccgagtttgaggagatgcatgttaattacaagaaatgaaagcaacccatccgcaggaaccacagcaagaggatgaaatctcttaaaatatgcatcaaaatgacctggaggctcctaaaaacactgattcttccccaaagtctataagcctttgttttggactgagaataagcatttctaatgagtcccagtgacactaatggtgaaggtccagggatgaaactctgataataagttttctatggaaaatgaggctgcctccccacgggctccagtccatggggctgcagatttgcaggctgtaagggaagagcctaaatttctaatctgtatatccccttagtatctctgcagtgagcaaagcaagcaaacaacaaaaatgccaccacattttaagtattcaaaattcagttttttatttcctgaaaattcttatattcattttatgttagatttcttaagtcttaccgacatctataaaccaattaaaaacagcttttattttaagagatttatatctaatttgttaataccctttccagaggtaggacaatgtttcaaactcaaaaaggggtaaaggctttctcaagtacagtcacacattgaggcttaccttcaggtgtgcaacttcatatacaagtgaaagaaaacacaggacacacatagcaatctagatctcaaagggcttttcttcccagttgaagcaagacgtgttcctctacaaggcaaaagactagtgtatcagattctttgccatgctgcatccaacagagattaggtacctatcatcccattatagggaataaacttactgtctgtgcagaaccagaatcacaaccaaacgtggctaagaatctgtctcatctgtccagtgttgggtgttgtgtgttcagccatgaatgttttaatgtgtgtttttttttgttttttgtttttgagacgaagtctcgctctgtcgcccagactggagtacagtggcttgatctcaggtcactgaaagctctgcctcccgggttcacaccattctcctgcctcagcctcccgagtagctgggactacaggtgcccgccaccacaccgggctaattttttgtattttttagtagagacagggtttcaccgtgttagccaggatggtctcgatctcctgacctcgtgatccacccacctcggccttccaaagcgctgggattacaggcatgagccaccgcgcccagccagccatgaagttttgttgcatcagaacaaaagtaaaaatacaaagtcaggaaaacagaaatagcagagaaacagaaagtcaataaaagtaaagttctgttgccacttgataatcactccagaagctaagaaaaactgtgcctgggaggtgtacactttaaatggcttaggaaagtgtagatacttgaacatcttggtgtatttccaaagttgtcaaagtataattttcaaaaaagttaaaaacaagactcataaaaatataaagtgagtgcatgtcaaaacattaaattcatgagggaaccaacgtaatgttaaggctggcttctgttttttacaatatttgttccagggggtacaaactcaaatactcaaaggggctaagcaagccatataaataaggaaagaagacatttacagtgttagagaatggtagagagtgtgacaaacttgagagcacattctttgtctaaagtgggcaactatggttgaccatcttcagctaattgttaccatgtgggaatgcaagcttagtgttgctagattttttcactttcatattcttttcacagaagtcattaagctggattttaatctgaatcttctagtttttaggtgtttgtaactaattcaaatgtttaaaaacactgtatgagccaaacagaacatatcttcaggctgtaaatggcttgagggccaccaatttgcaacctctgcagtagatattagttatatagcagaggaagagcttaaccaaaggttgtttttgtttgaaagaagtttcaaaagattattttaaacctttcactttgtttctcacaagagtaaaataagtacattatgtgataatgttttatcaactagtaattcagtgcctatcacataaccatatacatacattttaagttttatttttggccatttaaagcatgatcattttctggagatctgtttcacagtaatgtgaatatacttaatactactaaactatacatttaaaaatggttaagttgatacattttatgtcgtgttttttactacaattcatattatacagattcattttgaggttttttttttttttagggtggtgctcaatgtaacatatacaaggtttttacagaagttttatagtaggtaatgggaaatcctgggaacaaggagacattgtgaaaaactgttacaatagccttgccaaaagataagaacttgatttagataactaaatttagtaatgggaatggtgctcactttgagagacatttcaggggttaaattgacaggattcagggaacagctgaatgtggggctcgagaaaatactcagaagatcagagtatgacaataattaaagtaggaagaaaaacagattcagaggaaattaattcaattgtagacaaaccatggaatttcaggacttgaaggaaatctagaggttacctaatccaaccatcttattttacagatttgaaactcagggccccaagagattgataccttcagtatcacaatttaaatcaaaagtaggcttactttaataataagtttctagactgaaagtccatcttttcttagtacaccagagcatctttgctctgtgacagatggttcattcagttcaaagatgactttgggatggtactgtaatcctcaggctgttgccgtatgttagttaagaaggcctgcagacttcttcaagagaatggataccagagcctttttcttattctttaaactataagtgtgcctcctttcctatttgtagtcttttcttgggtttaagttacttatgggacctgtaaaggagatggtttgtagatgtttgtaatttcatccctagagttcaaaggaaaatttgaggctagaggtagagatttgggagtccataaaaataatggcaaaagttaaaatcatctaagtgaatggggttgcttggaaagagaacataatttcagagtagatgagatctggaaatgaaatctagagaaacataaaaaatcgctagattagaaagagaaaaaccagagaaacatattggtaaaagtagctagaaaataagagaaccagacaagagtacagatgttcctcaacttacaagggattatgtccggataaacccatcttaagttgaaagtattttaggtcaaaaatgcttttaatacacctaagctaccaaacttcatagcttagcctagcctgccttaaatgtgctgagaacacttacattagcctatagctggacaaagtcgtctaacacaaagcctattttataatagtattgagtatctcacgtaatctattgaataattctgtgctgaaagcaagaaatagaatggttgtaagggtatttgaagtatggtttctactaaatgtgtatgaatttagcaacattataaagttgaaaaattttaagtcaaaccattataagtcagaaaccatctgtagtactgtggaaaccaagagaaaagaaggttgtcaagaatgataaggtttgttttaggctgttttgttttgctacgacaaaatacatgaaacaatacagttgactcttgaacaacacaggattgaagtttgtgggtccacttctacgtgaattttcttccacctctgccaatcctgagacagcaagacaaccccttcttttactcctcctcctcagtctactcattgtgaagactaccaagatgaatacctttatgatgatccactcccgcttgatgaatagtaaatacagtttcttttccttttttttttttttttgagctggagtctattgctctgtcacccaggctggagtgcagtggcgcgatctcagctcactgcagcctccgcctcctggattcaagcgattcttctgcctcagccttctcagtagcttggattacaggcatgaggttttgtatttttagtagagacggagtttcaccatgttggccaggctggtgttgaactcctgacctcaggtgatccacccaccttggcctcccaaagtgttgggattacaggcgtgagccaccacacctgggctgattttcttagtaacatttactctctagcttactttactgtaataatatataatacatatataaaatatttgttaatctactgtttgttattggtaaggcttcataggctattagtaattaagttttgggggagtcaaaaggtatatatggattttcaactgtgcaggaggtgagtgccccaatccctgttgttcaaggatgaattgtgaaatttatttcttcacagtgctggaggctaagtccaagaggaaggcactggcatcttatgagggcattcttggtgtatcgttacatggccaaagacagaagggcaagagagaaccaacttctttctgtctctgtccagccccctttatttataagcatcgaaattcattcatgacagagaagccctcaaggcctaatcacctctgaaaagtcccacctcttaatactattacattaacagcacctgaattttggaggggagcccttcaagccatagcagagccatagagagggcaagaggatatagactgggaaggggaatgttactggtggcctttgagataattactttagtattttgttgataaatttaaattgccatggatgaggagaaaaggggagataaaaagaggaaaccaccatgttcatacagtgttctttttttcttttaattttattttcaacttttattttagattcaggaaaacgtgcaggtttgttatcttagtgtattgtgtgatgctgaggtattaggtatgaatgatcccattacccaggtatccaatggttaggttttcatcccttgtccccctccctcccatccccttttggagtccacagtgtctactgttctcatctttgcattcatgcatactcattacttagctcccacttacaagtaagaacatgcggtattttgtttttcgttcctgcattaatttgcttaagataatggcctccagctgcatccatgttgctgcagaggacatgattttgttcttttgtatgactatgtagtattccttggtgtatatgtaccacattttatttattccaccactgataggcacctaggttgattccacatctttgctattataaatagtgctgcagtgaacatgagggagcaggtatctttttggtagaacaatttgttttcttttggatatatacacagtaatgggattgctgggtcaaatggtagttctattcataagttctttgagaaatctccaaactgctttccacagtggctgaactaatttacagtcccactaacagtgtgtgaacattgttttttccacaacctcatgaaacatccattgttttttaattttttaatagtagccattatgaggtggggggaggggggagggatagcagtaggagatagacctaatgtaaatgacaagttaatgggcacagcacaccaacatggcacatgtatacatatgtaacaaacctgcacgttgtgcacatgtaccctagaacttaaagtataataaaaagaaaatagtagccattatgactggtgtgagatagtatctcattgtggttttgatttgcatttctctgatgattaatgacaagttttttcgtgtttcttggcttgtatgtcttcttttgagaagtgtttcttcatatattttgcccattttttaatgagattatttgtttttttttttttttgcttgttgaattctttaaattccttatagattctggatattacacctttgttggatgcatagtttgcagatatattctcccattcaatgtaggttgtcagtttgctctgttgatagtttcttttgctgtgcagaagctctttagtttaattaggttcactggtcagtttttgtttgtgctgcaaatgcttttaaggacttagtcataaattctttcccaaggcctgtgtccaaaatggtgtttcttaggtttccttctacgattcttatagtttgaggtcttacatttagaactttaattcgtcttgagttaggttttcttatgtggtgaaagttacaggtccagtttcattcttctgcatttgggtagccagctatcccagcaccatgtatcaaatagggagttctttctccattgcttatttttgtccactttgtcaaagatcagatggctgtaggtatatggctttatttctgggttctcttttctattctattggtctatgtgtctgtttttgtaccagtaccatgctgttttggttaatgtggccttacagtatagtttgaagtcaggtaatgtgatgcccgtggctttgttctttttgcttaggattgctttggttattcaggttcctttttggttccatatgaattttagagtagttttttctagttctgtgaaaaatgatcttggtagtttgataggaacagcattgaatctttagtgctttgggtagtctggacatttgaacaatactgattattccagtgcaggaacatggaatgttttcccatttgtttgtgtcatcggtgatttcttttagcagtgtttgtagttctccttgtagagatctttcacctccttggttagatgtattcctaggtgttttattttttgtgcggctattgtaaactggattgcattcttgatttggctctcagcttggatgttattggtatatagaagtgctactgatttttgtacattgattttgtatccagaaactttactgaagtcatttgtcagttaccaggagccttttgacaaagtctttagggatttttgtttgtttgttttgagatggactcttgctctgtcacccaggctggagtacagtgatgcaatctcggcttactgcaaccttgcctcctgggttcaagtgattctcgtgtctcagcctcccaagtagctgggattacaggcacgagccaccactcccagctaattttggtatttttagtagagacggggtttagcatgttggccagactggtctcgaactcctgacctcaagttaccctcccgcctcggcctcccaaagtgctgggattacaggcgtgagccaccgtgcctggcctagggtttttaagatacagactctatcatcagcgaagagagataattttgacttcttcttttcttttctttctttttttttttttttttttttttttttttttttgagacggagtctcgctctgtcgcccaggctggagtgcagtggcgcgatctcggctcactgcaagctccgcctcccgggttcacgccattctcctgcgacttcttttcttatttgccttatttcttgaaattctttctcttgcctgattgttctgactggcattccagtactatgttgaataggagtggtgaaggtagacatccttgtcttgtttcaattctcgaggggcatgcttccagtttttgcctgtttggtatgatattggctgtgggtttatcatatatggctcttattttgagatatgttccttcaatacctagtttcttgagggttttgatcatgaagggattttatcaaaagctctttctgagtcttttgagttgatcatgtggcttttgtttttaattctgtttatgtggtgaatcacatttattgatttttatatgttgaaccaactttgcgtcctagaaatgaaacctgcttgatcatggtgaattaactttttgatgtgctgttgaattcagtttgctagtattttgttgaggattttgcatctgctttcatcagggatattggcctgtagttttttccttttgttgtgtctttgccaggttttggtattaggatgatgctggctttgtacaatgagtggaagaggcatccctcctcaatttctgtgatagtttcaatagaattggtacagttcttctttgtacctctggtagaatttggctgtgaatccatctaggctgagacttttttggggtaggtttttattactgattcaacctaaggattcaatattggtctgttccgtgtttcaatttcttcctgattgaatctttccaggaatgtacgtgtttcttctagattttcttgtttgtgtgcatagaggtgttcataatagtctgaggatcttttgcatttctgtggaattggttataatgtcaccttagtcacttccgattgtgcttatttggatcttctcttttctttgttaattttattaacgatctatggatcttgtttatcctttcaaagaaccagcttttggtttcattgatccttgcatggatttttgggtccaatttcgttcaattccactctgattttggtatttcttttcttctttcagctttggggttagtttgttcttgtttttctagttcctccggggaagatgttagatcattattttgagatctttctagtattttaaggttggtgtttagcactgtgaactttcctcttaacactgcttttgctgtatccctgagattttggtatgttacatctctgtttttatttatttcaaagaattattttatttctgccttgatttcattgtttacctaaaagtcattcaggagcaatttgtttaatttccatgtaatttgtgattttgagagatcttcttggtattgatttctgtttttattccactgtggcctgagagtatagttgatatgattttttgtcttttattttttagtttattgagacttgctttatggccaagcatgtggtctatcttggagtatgttctgtgtgcagatgagaaggatgaatattctgtggttgtctattaggtccaagtgttgagtttaaatccagaatttctttgttagttttctaccttgatgatctatctaatgctgtcatgctgtcagtgggatgttgaagtttcccactattattgtgtggctgtcttttcattggtctggaagtacttattttacgaatctgggtgctccaatgttgggcatgtacatatttcgaatggttaaaccttcttgttgagttgaattcttcatgatgtactgcccttctttgtacttttttttttttttttcttgagatggagtctcactttgccacccaggcctggaggtgcagtggtgcagtcttggctgactgcaatctccgcctcctgggctcaagcaattctcctgcctcagccttccaggtagctgggattacaggcatccgccaccacgcccagctaatttttttggatttttagtagagacagggtttcaccatcttggccaggctggcttcgatctcctgacctcgggtgatccccctgcctcggcttcccaaagtgttgagattacaggggtgagccaccacgctcagccttctttgtcctttttttactgttgttgacgtaaagtctgttttatctaagtacagcaactcctgctcttttatgttttccattcacatggtagatctttttccaaacctttagttcgagcttatgggtgtcgttacatctaagatgggtctctggaagacaggtgacagataagtcttgttttcttatccaagctgccactctgtgccttttaagtgggtcatttagaccatttacattcaatgttgctattgatatgcaaggttttgattctgtcatgaagttgttggttgctgatatggtttgatttgtgtccctgcccatatgttgatttgtctcatgtcaaattataatcccagtgttggaggaggagcctggtgggaggtgattggatcatggggttagatttcctctttgctgttcttgtgatagtgagtgagttttcatgagatcttctttaaaagtgtgtagcaccttcccccttttctctcttcctcctgctctggacatgtaagatgtgcctccttcctcttcaccttccaccatgattgtaagtttcctgaggcattgtaagtttcctgaggtcccctgaagccatgcttgctgtacagcctgcagaaccatgagccagttaaacctctgttctttataaattaccctgtctcgggttcttctttatagcaatgtaggaacagactaatacagttgttttgtactttctattgtgtggttactttatagggtctgcaggctctgtacccaagtgtgtttttttgataacaggtattattcttttgtttccgtatttagaacttccttaaggatctcttctaaggctggtctagtagtaacgaattcctttagcacttgcttgtctggaaaatattttatttctcctttatttctgctcatgaaatttagtttggcaggatatgaaatttttgtttggaatttattttctttttagaatgctggaaataggccaccagtctctcctggcttgtaaggtttctgctgagacatctgctgttagcctgctgggattccctttttacataatctgccctttttctctagctgccttcaatatttttttctttagagttgatgttggacagtctagtgactatatgccttggtgatgttcattttgtatagtattttaccagtattctctggatttcttgcatctggatgtctatttctttactaagatttgggaaattttcttgaattatttcctcaaatatattttcctggttgtttcctttttcttcttctctcttagaaatgtcagtaattctttgttttggtcattttatataattctgtatttctcaaagactgttcattttttataattctttttcctttatttttgtctgcctggactagttcaaaagaccggtcttcaagctctggaattcttccatctgcttggtcagtctatttctttttttttttttttttttttttttttgagatggattcttgctctgtcatccaggctggagtgcagtggcacaatctcggctcactgtaagctccgcctcccaggttcacaccattctcctgcctcagcctcctgagtagctgggactacaggtgcccatcaccatgtctggctacttttttgcatttttagtaaaagaagtgatttttaaaatgtgtctgcacacagccatgtcatgtggctttacagggcagacaggaacaatgggggaaattcagagaagtcagttgataagaggtgggtagtggagggttttgtaagccacatggggagagctgctctttctctaggggctctgatagctaataataacagttaacaactacctggcatttattaagcaactggtatgtgctagagattctaaactaccattcatttgctcacagcaactctgtatgctgagtgtctgtagttatatgtgaagagataaagaaactgcagttgagtgactggcccaagatcacacagccaataagtgacagagttgtacccaagacttgtacatagatcttgctttgagagagtgacatacagaggtggatttacaatgaagctaatgaaacgtaaatttcagggttccccacttgctagacacctgtgaatgctgggagttgtcatgtttgaggtagagaggggaagctggcgtataaccagaaagcatttctatgtaagcatttctgggaacttgcctgatgccgtctcagaagaaaagttctggcagttttgttgtggtttattttcttcttgtaaatactcacttttgtaattgaacattgtatgtctgaaagatgagaagttcaaccatcagagaaggctacatgaaataaaatagcatgcttataaacaactccatgcagtttcacactgccgaatcatggcatgaggagagaaaagtgacaggagtttagactggtcaaaacctttcttgaaacattctaaggaataatgtatgtgtaattatatagtattctaaggaattttgactttatcctattagagattctcaacttcagctataaataagaattggtagatctgaggaaggaagggctgaaatatctttatttttttaaagctccataagtgagtcagatgtacagctaggaatgctgtaagcaatgagaagctatagacagatttgaagtaaggaagtgacataatcagatgtgcattttcaaagggaattctactttaaatggatgggaggagagacttgtagtagtccaggcaagagatgatgtcttttaatgactgcataatagttcatcaagttaagtttttataattctgttatgcattatttatgtttctagggatgtatatgtattcactgttactcaaaagaagtacatctttttgtattctttttttttttttttttttttttttttggttactctaatttttcactaggacagattccccggaataattctgttgagtcaaaggaaatgagtagttttggctcctgcttataaattattataatggttgtaatccattcctagagttgacttccatgtggtgggccaaataggaactttagaatcattttgtaaagttctaaaaaactatctgagttttgattgattttattttgaaattagcagtaaattatcagaacaatgctcacattgtatttatgataaccactcactcagtaactaaatgtatctttcatagattgatgaactcccagagggcgctgtgaagcctccagcaaacaagtatcctatcttcttttttggcacccatgaaacgtaagttagcaaaaatagtttcaacagctctagcttgactctgctatgctacattgttatggatgatctctgacatcttacgtcttattaaaatcattataatcagttatataaaattgccaaagttaataatgtatttttgttaatgtaaatagttttcatgatagaagtctttatgactaaaagcgtatctttgcttttgaatgtcatttgtgtttctgcttaaatgttggtcatcacccacaagtctcctctaggacacttttaagtcctagagtggtttctgtaccactcccagtaatttcttctattgctcttatatatttcccttccagagaagttttttccattcatatttcacagaacaaagttatgttctctctggctctttcaccttgttgggccctcaaggaaatataccaccttttttaggttttctaactgtatttgttggtgtactgactacactgatgtaataaaggaacctaaaaatacaatgtctcaaataatatagaagtttatttctttcttttgaaataattcagaggtaggcaggtagattggggtgggtagactactttgccctagggaccggagctgcttctgtttcttgtcctgtcattaaccgctaaaacaaaaaaactggctcagcagcacatgtgcatcttgcaggcagtgggaaggaggaaagagaagaggtgaagaacaagtagttccttgtaaggaaatgacaggaagttacatacagtagatcttcacttaagttgataggttcctggcaactgcgactttaaaggaaacatcagacagcaggctgtcaactaacttctttttgttcagtgttgtcacagtttccaaaaacctatcgacattaagtgtggacttactgtacatcatttacactggcattcattccagtgacaagaacttggtgatgtggccacatctagctacaagggaagctgagaaacagtctctagctgggcaactctgtatcctgctttaaaaattggaaggaatattcagtataggaaaaaagaagagcatgaatactgtggaatagttggcaatctttgacacactaggaacggatatggttatttacaacaaaaaacaaatggaacaaattggaaatgtggagaaaagctaaaaactgtcacaaaatttttaagtcttcaaattcagggtcatcacttatgttcatttgaacgttagtagagcctagcatgaactttcttagcttgttgtctctgccacccaacatcttcctcattcttgtcttgaaagagagttaggagaagcctctcaagacagactttttttcgtgagagaaataattgtaatttctctcaggaagttttatttacttttgtattatttttatgtaatagacattatggactatgcaactgatcatgttttcctccttaagagaggttgctagaaagcttagaaataagttttacctataataaatgtatagggctttatgatgcatatttttgcattttccttattcccgcccccattttatttttgtaccattggtttgatttttttagaacccatctccaaatgatctggttgtacagtagtctatatgtgatttttttgctggtttgatcatccagaggcagatttaaaaatacctgggggagaattaacttcaaaaaacctgtcataacattgattctactgaacttagttactaagtattgggtgtccctgaacctgagattatacttgccctggcaagtatgaatgttcaccctctctgaaggcagaaattatgtcagtgtttcttactctacttacacagtgcttaacacagtgcctggcccatggtaggtgtttaaaaaatagctatcaattaaattaaaattagttaaatgatgcaggggaggtatgtgaaaagtgaggtgagcttaacaagaaggctacgtttggttcagctaaaggagtaccctaggcacgaccagaattttcctcagaacatgactttgaatctgttctaattctgatgtaggtgactggagcctcaagttcttctgcttctaacataaacccagtagttttagtctagacaattttcaaggaacccttaacatggaaaaatatatcatcctcagtgcatttagctttgaaaaaatgtattttcttttctatgcttaaaaaattttaaaacatatagcaattaaccaattgagaggggatttgatttacacaattatctataatccagaaaaaaacagggttgtttatcaaaaaattacaacttgttttagaacagttcattcaggctccctcttgccggcagtagctaacatggccagttgtcagttaaagtcattcctgcggaatgctagtaaaaatgtatcatttattcataaaagaatgcttcctgtagcaggaagacgtccatctcatacatccaaaagtgggacaagataaaaataaagagggcaaaaattgttaactctttcatcaaaaaataatgaccattagccctgactcttctggcattattacagtataggcagctgagtgcagtggttcatgcctgtaataccagcactttgggaggccaaggctggaggatcactttagctcaggagttcgagactagcctgggcaatatagtgagatcccgtctctacaaaaaaataacattagccaggcatggtggctgtagtcctagctactcaggaggctgaggtgggaggatcacttgagcctggaagccaaagctacagtgagagaccctttctcccctgcccaaaaaaataagtataggcaagccctgattagcatcaagtagctgatgtgaataccaggcagcttagcccacagttatttcttaagcatagagtcaaagactggggaaggtcaaaagctagagtctaataattcacgacaaattcttctaaaagtgaagttgccatacacaaagtccatttattgtgttcagtttatcaagcaagactttgacttttttttattaagatgtccagtaatgtaataaattatttctggattcaatgaggtagaatcatgctgactgagcaattaaaggtgaacaataaggaaaaggttggtgcttcttaaaagtttggtgcttcttaaaccgctctggggtcagaaagcttacccaggagttttaatgaacttgaagtttttgatcagctgcacaatgcgagggatcaaccctgagacccaggcagaaaatggaatttacagagatcaatagtaaactgttaacctctcgtctgaaagctttcagtatcttctctttactgataatttccaaatttacatctccagcttacacatttcccctctactccagagtcctctctccagctacctgacatctccacttggatgtctaaactggattttaaatgtagcattcaaaactgagttttttgcccccaaatattgttccccccccaaaatatttccatttcggtaaataccaactccttcttatttctcagtccaaaaccttggagatggccaggtgtggtggctcatggctgtaatcccagcactttgggaggctgaggtgggcggatcacaaggtcaggagatcaaaaccatcctggccaacatggtgaaaccccgtctctatcaaaaatacaaaaattaactgggtatggtggcatgtgcctataatcccaggtcctcaggaggctgaggcagaagaatcgcttgaaccagggagtcggaagttgcagtgagccgagatcgtgccagtgcactccagcctggcgacaaagtgagactccgtctcaaaaaaaaaaaaaaccttagagatatcctcaactcctctaccctttctcacatatgccatatgcagcccatcaacaaatcttgatgctctttcttgagaatgaattcaggatctgaccacttcttaccaacagtactgcttacaccctggttcaagtcaccatcattacttcagaagccttctaattagtctccctgcttctactgtagtaactaagtcttcagtctgttttcagtacagcagccaaagttatcctattaagacataaattgccacttctcttctcagaacctttaatggcttcccatctcactcaaagcctttatagtggccttcaaggccctaaataatctgtgcccctactctgttaacctgtctcacaccagtcgtccttcactcatttcactctagccacactgacctcttctgtttctcaaacttatgaggcactcttcctctcccacctgagggaccttgtacttgctctttcttcaacttgttcttttcttctccaggtaactgcatgagttattccttcactttctttgttctttacttagctattccctttgccttccttgatctgtatatctataattataaaatccatctcctattcttcccatccttctctgctttattttttttagcacacatactatatattttatctttttattgtccaaacccccacccctgccactagaacatgtgctccaagaaaacagagatgtttgtctctttgttccctgtagctcctctggaatagtgcctggcacattgtattaacaaatgttcaatcaatgtttgttgaatgaaggaatgtgtgaatctcagtttgagaagtaagctctaggggtgtcagccagaactgtggcctaatgctaaagactctgatctattagccaggctcagaatttgttctaacttctttttttttcttggttgtgattaatttaggatgtggtttaaattggataaaagtctatctgctttgtcacttctaatttttttcttagtgcctcattaaacactaaaatgattttttaatttatagaaataataggctgggcacggtggcttatgcctgtaatcccaacactttgggaggccgaggcaggtggatcacctgaagtcaggagttcgagaccagcctgaccaatgtggcgaaaccccgtctctactaaaaatacaaaattagtcagatgtgatggagcatgcctgtaatcccctacttggaaggctgaggcaggagaatcccttgaacccgggagatggaggttgcagtaaaccgagatcataccattgcactccagcctgggcaacaagagcaaaactctatctgaaaaaaaaagaaagaaataatagtgaataaatatactaacgtggtacagtagtgccccctttatctgtaggggatacattccaagacctccagtggatgcctaaaaccgtggatagtatgaaacctatatatactatgatttttccatctgataacagagatagctattaagtaactagtgggaaggtagtgcaaatatgatggatatgctggacaaagggatgattcatgtcccaggcaggatggagtgggtgtgagattttatcacctgttcagaggggtgtaatatttaaaacctatgaattgttcattttccattggaccacagttgaccatgggtaactaaaaccacagaaggcaaaaccacagttaagtggggaattactatatagagagttaaaatcttttttttattctagcatttatatttttactgtgaatttcacaaaacccttacctgtggtaagattaacatagataaatcttagtttaagatgatgatttaagtggccaaagtagacatatttaattctacttatgtaactaaaaatcagtttttaaatgaagatattgataatttaaaagtaaaatcaaagtagcacaatccaggtggctggcttgtatgctcagctatccattttttctgccttgaagtatgtgtctgaaacacctcgtaatatgtgcctaacttgaagggtttatatgtactttagatttgtttgctatagtatgctctgacatcttcactgatactgatatttaaaatatcttacctttgaaggtcagtgtgtcaattctatttctaatatgtctctgcagtgcatttctaggtcccaaagacctttttccatataaggagtacaaagacaagtttggaaagtcaaacaaacggaaaggatttaacgaaggattgtgggaaatagaaaataacccaggagtaaagtttactggctaccaggtaatggtttacttccttgtcacttgctatatctcatttctttggttttaacgctttttcaaatctttcttatatgtcctttctactaatagttaccttgaagtcacaattctttttgactccagtagcattttggattaaatgtaattcttaatcagaagggttcaaatcaagtgtccattggaaaattcagtttgacagccctttgtttttgaaaatcttccgagtaagcggaaccctttcaaatgaaaacagagtagttcttttcagtgtttgttctttgctattttttcaaaaatgtaatcagctaatattttattatttcttaggcaattcagcaacagagctcttcagaaactgagggagaaggtggaaatactgcagatgcaagcagtgaggaagaaggtgatagagtagaagaagatggaaaaggcaaaagaaagaatgaaaaagcaggctcaaaacggaaaaagtcatatacttcaaaggttactaagaaacttctcattgttattaatgttatatgcatatccattaaacatttttagattattttccatgtgtttattgggtacatagaaatatactaaattctatggagcctctgcctttagggacaaaatacagcagagggaagtcaggtaaccttagatattagagcaatctgactattgactctttagggctgatttggccctgaaaataccacctttttagttggaggaggactgactgttctttagttaaggatatatgagtagctttgcctcctacagtaacctccagacgagctctaaagaattgagaaatgtaggaaacacaatataattcaagactatgtctatgtactatatgtgtaaatgcatcacatgtaacttaactatggggttctaagaaatgcatcatggctgggcgcggtggctcacacctgtaatctcagcagtttgggaggctgaggcaggcggatcacaaggtcaggagatcgagaccatcatgactaacatggtgaaaccccatctctactaacaatgtaaaagcaaaattagctgggcatggtggcgggcgcctgtagtcccagctactcatgaggctgaggtgggagaatggcatgaacccaggaggcggagcttacagtgagccaaaatcgtgccactgcactccagcctgggtgacagagcgagactccatctcaaaaaaaaaagaaatgcatcattaggcaattttgtcattgtacaaacaacatagagtatacttacacaaatgtaggtggtacagcctaccacacgtcaaggcttcgtatatgtggtctgtcactgaccaaacattactatgtgacatgactgtaaaaagatatatttttacttgtcattctgcttcaaagaatgtgctttggctgtttatttattcagttcttttatttcctgatcacctagtctattccagacaccagactaggtatacagcggtgagcaactccattcctgccttcacataaattatagtacaacagagagtgggggtagcacacagtaatcacgtaaataataaattgtgaaagggtgtgaaggaattgaatgggagcagggggacctaaaataggtcccctattttagatagggtggccagggctttctgaaaacgtgtagtttatgctgagacctcaaagaagagagtaggaggagaagccatatatggcagagggaaaggaatgtagcatcaaagctctgaggcagggaagagtttagcatgtttttcctgtattgaaagaaggtgtggctggagaatcatgaccaagggggaaaggctggcaaaggcctaattatgcagacttgtaggccataatgagaaatttggattttattccaaatctaacaatacttgaagattttaaacagaggaatgacatgatcctagatttacaaattgaaagtctaggttttttcatatggtaattcagaaatacaatggaaagaactctgagattgtgaaaattattcaccttttagaaactgaaagcaagataaatggatccttgaagaccaaagattggtacaggtttcactataattggtctgtcacatgattgaatacctggataaattacttctatttaaattctggtgtttagtgactgaatacacttaggaaactctaaaaacaagtacctagagtttattagattatcagcatttattttggcagtatataaaatcttacccaactggcatacaggcagaattgtgtgaatgcagcattgtttcctgtgtacctaatgaaaaacatgtgattgccttggatggggataaagtttgcaaatgacgacaaagtaattagaatttttcttgtcagactttatcttccattgtaattacttttttaagctgaatttcttttagcattttggacttcatttaaacacctacttgaattgattttacttaatttgtgattgcctgctgagcttccacctaatgtgttgtgcaaccctaaattatctaagctacctaatgttgcctaggcatttaatagtgtggatatgtggcttttaaatgccattattttattgcttgttacaaagaccaaaagtaatggggctccacctgggtggacttaaaatttaaagcagagaaagggtaaagacacacttagcttactaatgtttatctattttaaattaagggatcatttcctttgctttccttgaagattacaacttcatgatcatttaatagccttttggctggtcacaatggctcatacctataatcccaacactttgagtggctgagacaagtggatctcttgagcccaggagtttgagaccagcctgggcaacatagtgagacctcatctccacaaataataaaattagccaggagtgattgctcacacctgtagtccagctacttgggaggctgaggtggaaggattgcatgagcccaggagtccaggcgagtactgagccatgatcatgccacggccctccagcctgggaaacagagtgagaccctgtctcaaaaggggggaaaaaaaagaatagctttttatttttaatatcaatgaaataacctagcataatggttctcaaactgttacatgttttagaattacatggaagacttataaagacaagcttacattgtttgacaagcttgccacattgaatagttatactgtatttactaggagaacaaaaagtttttcacttttactatcattcttgatcttaactggaaacactccacatttgtatcattaaatccctgttttcccttcttgtaaaaagtaaaaatcaccacattataacatgacattttaggtttggttggtagtttcagttaagtaaaatagaaacattgttgaaccccatccccagaatttctatttcagaaggtctagggtggggtctaggaatcaaatttccaggtgaggcttatcctgctgatctgggaaccacatttagagaaccgcttgcctagcataacttcattgttctcttttgcttcccaaatgctttttaaaaaacaaatatggtgatttttccttttttttttttttctttgtcttgagacagggtcttgctctgtcacccaggctggtgtgcagtggtgcaatctcagctcactgcaacctctgccccctgggctcaagctgccctcccacctcagcctccccagtagctgggaccacgggcgtacatcaccacacgctgcttttttgcttttttatttttgctttttttttttttccagtagagaccggattttatcatgttgcccaggctggtctcaaactcctgagctcaaacagtctgcccgcctcaacctcccagagtgctgggattacaggtgtgagccactgtgcccggcctgtttttatgtctatttcttaagagttgaatggtcttcctttgcatggaaaattagtggctcacaaacttttttttactacattccagttgggtagaggaaaaggccccacacctgtctcctctacctcacctaatttcagttttctaaggaaaacgctcagtaatcacaatgaaaagtcatgctatagtagatttgagggagattatatgtcttctctctttagcagtaaggctatggattattcatatttgagtcatagcagatactggaaaatcataggtcaaaaatattttgcatacaaattatttactatttacaataggactaatgagagcctcacaacaaactaaactgatgttgataaaccaccagtaattttagtttaaaaaaacaaagatagcaaaaatcaaacacataaccaatttaggaccacactgataaaactgagtccttctccaaaattacaggagtttcagtaatctgaaaagcttttcaagattaccaaatagagcttggcaaccagatttcttcatagaataccaaatgttgtgactcattaataaaacactagtaatgccctaattctattctgtatatcccaaatacatgccaaattgtaatacttataaactaatttataaggttactcataaagatcctttatgagcattagaaattttagggagttgttcattattatgagaactgccaggggccaggcatggtggctcacgcctgtaatcccagcactttgggaggccgaggcgggcagatcatgaggtcaggagatcgagaccatcctggctaacgagaccatcctggctaacacagtgaaaccccatctctactaaaaatacaaaaaagttagccgggcgtggtggcaggtacctatagtcccagctactcgggaggctaaggcaggagaatggcatggtgtgaacccaggaggcggagcttgcagtgagccgagatagccccacggcactccagcctgggcaacagagcgagactccgtcttaaaaaaaaaaaaaaaaaaaaaagaactgcgtatcgaggactgttatttgaaaatcactatataaagcagttgctacattttaataattatactataaagagaaagtgtttcacttttactattgtcattcttgatcgtcacttgaaatactccacatttgtattattaaatccctgtttcccttcatgtaaaaagtaaaaatcacattttaaactgacattttgggcttggctggtagtttcagttaagtaaaatagaaacagtttaattatatattctgccacacagctagaggacgttttctctttttttgttttttttttttttttcgagacagagtctaactctgtcacccaggcttgagtgtcactgcaacctccacctcccaggttcaagtgattctcctgcctcagcctcccaagtagctgggattacaggcctctcgccaccacacccagctaattttgtatttttagtagagacagggtttcaccatgttggccaggatggtctcaaacccctgaccttaggtgatctgtccaccacagcctcccaaagtgctgagattaaaggcgtgagccactgcgcccagccccaggtaatttttgtagttttagtagagacagggttttgccatgttggccaagctgatctcaaactcctgaccttacttaggtgatccacccgcctcagcctcccaaagtgctgggattacaggcgtgagccaccatgcctggcctatgttttctctttgaaagttgcatttttaaaaactgattatctgaagaagcttcagtttgctcattcatttctggaagaccagaagtaacttggcaaaatcagttttgccttacctcttacttgcaacgtgcttgaagactcttaaaatgtctcaaagaggaagtgtagaaaaacactatattttactttcttaaggcgcacaattggggccagctttctataattttaatgcaatgctgccaagcaactcttgaggcaaactaattgtattttcatcttcctctagagttcatcttgttttcaaatgcaagatgacgaggaaaaaggactggttcacagtatggccttgagttcttaaataatgctccacaattgaaaagattagtttatatcaaacagttttatcaagatgattctgggtatcccattagccaaacagcttcaagaggtgttccagcatgaatatctatatattctcttggatagttcacctcacttctttcaatttccactactataaaatgatggggaggacaagatgacctttagggtaccttccacttctgtagccttcttaaggtggtgtccatccagctgtatttattcattgacagtgttctaggtacattaatcttcattttgtgcttttaatatcacattgctggaaataactaagaggtcacctagcccacttctgcttcctttccagctagttaaactgaggtccaatgaggtgaaatgatttgtccaatgtcacctagctcagccttggcatactacatgttgtgtcagtatatcctctatcaaccactaaaactagatagatgcaagtcagctatttctgcatctcttacttgtacatttggatttctgcttttgactataatatttaacttgtctaaacatttagaaatcctctaaacagtcccggaaatctccaggagatgaagatgacaaagactgcaaagaagaggaaaacaaaagcagctctgagggtggagatgcgggcaacgacacaagaaacacaacttcagacttgcagaaaaccagtgaaggggtaaggatgtgcttataatttctcttaccttctattagaagacattttgcttcagattcagcatccatatgtcagcattagtaaacattgtgttgataaatggagaagtattctcagcctattatatgcatccactcagccctttaatataatcaaattcttagagtctgaacaaaagagccaagtgagaattatacctgcctgtcaatttggatctctatgaacaggtttatttttctttatactaactttagagtctttttaaagtacaatgtgaaatactgaaattatgaaatgccaccccaaaattcaacagttgtatttctgttatcacaaaatcaatggcatgttcaaaatagagtattacatactgctgcttctttcccagaagcagtgtgtaattcattgtacccatgaggactttaaatatgcaagcaatgtttgaatattgatatttaaagtacccctagggacaaatttgtctatgatgactcttcataacttttgttaacctttgttaacttcaaagcacaggtaagtccacctttgtaaaaaacttgatgaaggcaaattttgcccccatgcattttccatgagtctttcctctatgaagactagttagacaatgtcaaatcatttaaaaataatgacctaagaaatttatctggtttcagcagagttcttgcctgttcatgtcagtcctgtttacctctcaactcttttcttccttcatcccagttatctataattactcccaaagtattatgattctgattgttctcttattcctctcacccagctcagccctactctatcctctgcttatcttcatcctcttgacttttctttaataagtagtcctctatcattacttttgccagcagccttcccagggacatatacctgctaacagtcactgagaacttgaacacctggctcacttgattttctttctattcgacctgctacctttatgtcaggtcgcttcaatatgcaagtagcaacaactccaacaatttctcttccctttactaccaaacttatttctagatgcacttctcatgacaaaggaagagttgtcctacccccttaatactcagaatgtggtcagtgaaccagtagcatcaacattaggtaggagcttgttagaaatggagaatctcagacctgcccgaaactccagattctgaatcggaatctgcattttaactcaaccccaagtaattcatatgcacatgaaagtctgagaagcactaatttacatctttctattgtcatggttcagaatattatctcctcctgttttctccaaagcacacccagtcattcgtccccttcttctataccacatcttcttttccactggctccttcccctctgcctataaacagcctaaggtctcccttaatcttgatgatacctcccttccatcttatattttacccttttcacttttcccttcatctctaacttcgtaaaaagaatgatcttttctcccagtctccatttcctctcctcctcctgatgacttaacccattgcactcttatttcttctttgaccacttcattgaaattgctcttgtaaaggttcctagtgatcctctccttgcccgatccaacgtctcatttagtcttcgttttcacctctgcaaaatttaatactatcagacatttctcctcctgacttttcctccaggttaccaatctgttctgcttcctctccctgttccttcttagtctctttctagagctccttccttcagtctgacttggcacacttctactctgaaaacatcttgtgttcatcttatccatacatatgatttcaactttactgattacgttttcattctatatatcctatgcattgtagattcattgttctaaccactaataaaaccatttcttcttgaaagcaccttagaacataatagctgctacagctagcactagtatcctgtgtgccacatattgtgcgtggtctgcattcattatctcatttaatcctcatacaaacttcaggaggtaggtgcaggtattgcttttgctttttagttggggaaactgagactgaaagaattggcctaggatcacacagctagtaagagctcaagtgggaagcaagagcctatttttaatgatatatttgttatatacaaaataatatatataaatataaggttataaagctataaagtgaccctaccaccgaacctaaaaactagaacatcacaattaacttgtatctatttacgtattctttccagtccctcttcctacccagagatgagcactaatgttgtattatttccttttctttttgaaatgtttgcccatgcctaacatataggtgtataaacagtatattgtttagtattacttatttttagctttttaaaaacttataacattcactcagcactgttttcccaagattccttcatgtggttatgtgtagcagtagtctattttaactactgtataatattcagttttatgggtataccacaacttatttatccagtctcctattgatgggcagttgggttgtttccagctttttgcaattattattattattttttttttttcgagacggagtctcactctgtcgcccaggctggagtacagtggtgcgatcttggctcactgcaagctctgcatcccaggttcacaccattctcctgcctcagcctcccaagtagctgggactacaggcacccaccaccacacctggctaatttttttgtatttttagtagagacggggtttcaccgtgttagccagggtggtctcgatctcctgacctcgtgatctgcctgcctcagcctcccaaagtgctgggattacaggtgtgagccactgtgcccggccagctttttgcaattattatgaactgtgtggctgtgagcattctcatgcctgtctcctagtatacgtgtacaagagtttatttaggatatgtaactagaactgaaaatactgagccgtgagttgatggattttaactttacaagataatgccaaattattttccgtagtagttggacattctcaccagaggtgtggaagagttccctgtgattaacttggcatagtcaggctttttaattattgccaatatagtgagtataaaatggtcattatagtgttaatttatagttctctgattaatgataaggttgagctgcctttcatgtttattgaccacccatgttttctcttctgtacagcgcgtgttttgggttttgcccattttcttattggatttcatttcttactgatttgtaggacttctctacatactctagattctaactaacatggatcatcatatttcttgcagatatcctctccaagtttatggcttgtctattcaatttctttctgatatttttagcaatcagactttttaaattttattgtattgtagtcagctttatcagactttccttttatggctagcatttttctgtcttgtttaagcataaccatttgaaccagcaccatttattgcatagtccttccttttttctctgatccgcagtgcatctgtcgtatattcataggtctctctctgggttctctattctgttctgttggtcaataccacactctcttaattatagtagctttataatgagtcctgatatcatgtagggctaattgaatagttttagttttcaaatatttaatagtcatggtctgggatagaagttcaaggaaggtctttttttttcttgatgggagaatttacatatgctagtaagaatgatccaagtcagaaatgatcacaaaatgataatgtaagaaagaattgctgaagcagtgtcctttagaaagcaagaaggtagggccaggtgcggtggctcacacctgtagtcccagcactttgggaggccgaggcagatggatcacgagatcaagagatcgagaccatcctggccaacatggtgaaaatacaccatactaaaaatacaaaaattggctgagtgttgtggtgcgtgcctgtagtcccaactactcgggaggctgaggcactaaagtcacttgaacccgggaggtggaggttgcagtgagctgagattacatcactgcactccagcctggtgacagagcgagattctgtctcaaaaaaaaaaaagaaagaaggtataagatctggtgcacatctggaggggctaccttggttcatccattaaattggaaggaaaggcagagtatttgggcacggatacaggtaagtagatacttggggtgagagcttgtagaaattcttacctgattgcttctattttcttaaggaacaaggttagcatttgagactgagaataggaaaaaatgttggaagattcaagagagagaaaaaggtacaaaatagtcatttagaagaataagagaatgaatgaacttgggaaatgaagttgaattgccaggtaatactaaaggcttgcttgagaccagtggtcttgaatttaaagtgagaggggtcacaatggttgtgtgtttttctccaggcatattcaattattcagtcacagagaggacagataattgaatttaactagaattaaggttttcgcagagagtagggtaaagaagattagaggccagggaatcaaggatgtgtacaaggattataacaatggaccatggaatccaacatatcttaagaggaaagatgtaaatgagaaagggagagagtcaacagagtttgagtatgacctggaaatataaatggtgatagaagagtgaggtatttgaatagaatcatggaaaggttgcagtagttgccgatgacagtgcaggtgctactagtatttccagtgggacacttaattcttcattgtacgagcactgtctacatcacaagacatttagtacccatggccctgtgtgttaaatgccagtagaaccccagagttcttaataataacctaaaatgcctacataattttgctttcaaaacagtggcttaagacagtatttacagttactcccagtggttgtgaatcacttgttttaagaaagaaccatggactttgggaggctgaggtgggccgatcacctgaggtcaggagtttgagagcagcctggccaatatggtgaaacctgtctctactaaaaatgcaaaaattagctgggcatggtggtgcacacttgtagtcacaggtactcgggaggctgaggcatgaaaatcgcttgaacccgggaggcagaggttgcagtgagccaagatcgagccactgcattccaacctgggcgacagagtgagactccatctcaaaaaaaaaaaaaaaaaaaaaaaaaaaaaaaggaagaagaaagggagagagagagaaaaaaaaaaaagaaagaacaaaccatgggagcgagtgactgaggtagggtcttagaagacaagatctttggcagagaggacaccaaggaactgagataccagaatgttagaaagataatctatgtggatattgaaatcacaggaattatgatgaatgacagagggccagaagtgaaatctttaaagagtaaggagaataatccagggagtctgtagatgattgcaggaaggaggggagtagcttacactgagattcaaaactgggaggcttttattttcagggaaggtagggcacaggggagagaatgaatagcttataaatagtagggaggagcaagaaggacaccttctccacctccagggcaagtagtagtacaagagctgtgggagagaacagagctaccatttgagagggttacagggaaagaggcagcactgcccttagaagaaaacaggttttagttagaacaagttgttgagtggaatttcttggaaattcaaattgagaatataggagttttgctaatggctaaccgtggttttcagggggcccagtagaagagattaaagaatggggttgggggttctgttaagaaatgaggccgtaaaaggacctgtgcaaagctgactggggatatgagttcaggaagtgatgggtgctctggagcccatcttatagtatccagagtaagctaggataaagggcataatgataaaaagcctgatggtctcaaagcagatgatgggttgatgttatgcatattgttaagggaaagaaagaagagatttttacgagggtccctttttgctcccagaggctctctgagtacttcctcccttctgccactagcagaaggagacagaaaggagcaggcgcccttatctagaatgcttggagttccttcgattcatatggatagaaggtgaaagttactcatctgtggccaggaggacaccatgcactgattggcttacacctactgtattagttatctattgccatgtaactgaaaactagtgacttaaagcagcatttattatctcatcttttcaagactcatcaacagtccattcaggtgcaacttgctaaatcctctggctctgggtctcttgcaaaaggaactgagataccaaaatgcagtccaggtgtcagcaggaactcagatcatcttaaggctcaactggggatggatcctcttctaagatcactcaaattgttcctggcaggattcagctcctcacggttgttggactggaggcctcagttcctcatgagttgtttcccagaggcctcctctgatgccttgccccatggatctcaccatgaggcagctcacagcatggcagctggcttcatcagagtaagcagtaaagtgtcagtaagagagagtgctggcaaacagaagtcagtcttttgtaacctaatctcagaagtgacatcccatcacttttgcttcattctgtttattacaagcaagtcactaggtccagcccacactaaaggggcggtgattacacaagaatgtgatgtagagataccggaggcaggaatcattggagactatatcagaaggctacctatccctaaaccaactactgatacaagaggattagaactggctcacaccattcaggttctccacacccctggagctggattcaggtcgctaaatcacaaggttaccacacagctatggcatccgcctgtagtcccaactacctggggggctgaggcgggagaattgcttgagtccaggagggctgcagtgaaagatactagtggtgggcagccttgtctggtgctgacgattgcctggcagtcagtggaggggaaggtctgagaatcgtgccgtatcggtaagttgggacttaaaatttgtaattattccaatatatttactagagattatttggaaaacagaccctcaaatgacaataaagtcttatatcattaaaaacaaacaaacaaaaaaaacacaaggctaccacacaactggagggagggacagaggataaacattggaatgatagctacaatgtttactgtaacgatttaccatgtggccatgcctttattcttctgaccctgaacccgttctttctacagtatagtggctgctgccttatatctccccagtgccccacaagattaagtctgcgttccttattccgtcatacaatgcctttcacagctgaccccagtttatctttgcagtcttacctctcaccgtttactctcatttattcttggtctcaggacctccttaataccattaaaagtttgtttgtttgagatggagtttcgctctgtcgcccaggctggagtgcagtggcacgatcttagctcactgcaacctccgcctcctgggttcaagcgatcctcctgcctcagcctcctgagtagctgggattgcaggcacgtgccaccacgcctggccaattttgtgtttttcgtagttaggatttcaccacgttggccaggctggtctcgaactccagacctcaagtgattcgcccgcctcaacctcccaaagtgcttcgattacaggcgtgagtcactgcacctggccccctttaaggggcctgtaatctcaacactttgggaggccaaggtgggtgggtcacctgaggtcaggagttcaacaccagcctggccaacatggtgaaaccccatctctacaaaaaatacaaaattagctgggcgtggtggcatgtgcccgtaatcccagctactcaggaagctgaggcagaattgattaaacctgggaggcggagattgcagtgagctgagattgtgccactgtactccagcctgggtgacagagcaagactccgtctcaaaaaaaaaagttattaagggccccaaagagctttgtttatatatgtgatcgttaatgatatttatttaattagaaataaaaacaaattttaaaaatacttaattcatttaatataataaatccattacttaaatagcatttttatgaaaataacatttcacagaaaagtttgcagaaagacatttttacatttttgcaaatctttttaatgtctgatttgatagaagacaactagatcctcatatctatttctgcattctctttattgtaatatgtaattgtggttgaaggtatatgaagaaaatctggtattatacagatatttaattgaaaaatggtgatatgagtatcttaatcgtcttgctttttttttaaacttcagggagtacatgtgcagatttattattaaaggttaactcatgtcacaggtgtttgttgttaccctgggttctaagcctagtatccaatagttactttttctgatcctcttcctcctctcctttaccctccagtaggccctagtgtccattgttcccctctttgtgtccatgagttctcattatttagcttccacttataagcaagaacacgcggtatctggttttctgttcctgtgttagtttgttaaggataatggcctctagctctatgcatgttcccacaaaagacatgctctcactctttttaatggctgcatagtattccatggtatatatgtaccacattttctttatccaatctgtcattgatgggcatttaggttgattccatttctttactattgtatatagcgagtgctgcagtgaacattctcatgcatgtgtctttatggtagaatgatttatattactttgggtatataagcagtaatgggattgctgggttgaatggtagttctatttttagctctttgaggaattgccctactgatttccacaatggttgaactaatttacactcccaccaacagcatataagcgttcccttttctctgcaaccttgccagcatctgttattttttgactttttagtaatagccattgagttgtgtgaaatggtatgtcactgcagttttgatttgcatttctctaatgatcagcgatactgagcttttcttcatatgcctgtttgtctagcgctctgaatagctttcccccagttagaaaatataggttttctgaattacttgggtcttccaaatattcactcatttcagtacaaaatgtttttaatcacatttttaatatcactacctatctcatcagaaaagtctttaagtattggggccaagtttggtggctcacacctgtaaccccagcactttgataggctgaggcaggaggatagcttgaggccaggagttcaaggctgcagtgagctgtgatcacaccgctacacttagcatgggcacaagagcaagaccctgtctctaaaaaaaaagtctttaaatattggaaaactgtcagtcatggaggatttgaaattctagttttcactgaacactcaaattttatcattggcaaaaaacagttgtttttctgcaagtaataagttacttatttgttataacgtgccaaattgcccagtctgcatagccatattgaatattatcattccttcatatcaaaatggtactccttgaaaagatccttacggcttctgttgtttcatagcttctgcttacagtgttctgggtatccttcagttttgctaccaccctatagcctctcagtgtgcctcacatttagatacctccagagagaatccgattggattcttcagccattatctaatataggggtgcatggcaaccagtgcataaggaaccacttgtggctacttactcagaggagacttcagatctaggagacagtcagagtaccatgtccagaatatataccatgatgaattagcaagatgcagttttcaatacatagatgcaaagtgattatggtatgagaattttttaatctcagattttgtaatttgcttttacaaagcacccatttgacagcaccttgtttaaagaccacaaaaagcatgtccttaaaactatagtcacattcttggtgctcccttcactttgtttggggtattaatactactctgaggctgccatgggaccacctgttccaaaaatattctttgatgtggattgagtagtttttactgtgattattctaccaagataaacatagaatttattgcctttcacagtaataataagaaaacattgttaaagaaggtttcggccaggcacggtggctcacgcctgtaatcccagcactttgggaggccgccgagccaggcagatcacaaggtcaggagtttgagaccagcctgaccaacgtggtgaaatcccatctctactaaaaatacaaaaattagccgggcatggtagcacacacctgtaatcccagctactcaggaggctgaggcaggagaatcacttgaaccggggaggtggaggttgcagtgagctcacatcacgccactgtactccagcctaggtgacagagcgagactctgtctcaaaaaaaaaaaaaaaaaactttctttggttgactaacaatttttcattgttctaatgggtgtcttcctccttcacaagggaggaagatcctccaaagtatctgtgagtataatcttataactggtgtttttgttaagaaataattaggagtcaccaggcactccattttttaagttcacaaatttcaaactttttttttaaagatttacttcctcattttaatagggacagaaggataaaaagtatatttctgccatcttagggggatggaagttttggtaactctctctcctttgaaggtcctggaatcgtttattataatatataccatttagtatacatgttgggctgtctgaatgagaacatacccatcagtgtgcacatgtgcttacaaacatgttcattcatttagtgaaattaagagtggaagcaggctgttttcagaaaaaatatttgagggctgagttccctctttcattcatcccatgagggtattactagggggtttaatatatttgggttaatgatgagggggaaaaaatagcatccttttggggaaatagaaccagacacaatttaaagtgggacccaaatagaaacataattcttttatgaaacaaatgttttattttctgtttgtcacacggatgccatctaaattttaaaagaaatctaggcttcctcttattctttatgttttttttaaaagcaagaagtcagagactttgtacatcatgattaacttctacatttgtttgagctatgtgtcacaagtaattaagttataaatattctgaagattaattggtgcacactctaagtgctttttaaattttacacagcttacctttctttctgaagaatgtcctcacaaagatagattatatcaatttctccactgatgatgtattccagcaataaacatagtcctagaattgtagaatgtgcactgctgcactctgtcctaacagacagtagacaaggtttataatttttttctatgggacactaaaaataccctaggatttcctttaactttttgcactgacaggtctaaagcaaagccacagaagctgctcttgctcagtaagtattgttaatgctgcagtgcatattaaaatttcagaaaacccaattatgtactatctaggtgtggatagctctcattgttagtatcctaaatcatctaaaggcttgttttctttcttttttttttttttacagacctaactaccataatgaatgctgcatattaagagaaaccacaagaaggttatatgtttggttgtctaatattcttggatttgatatgaaccaacacatagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaaccatattgtaaaatatctattccgtattagaaatagctagttgacagcttatacttctcaaaattcatattgttatgtacacaaactaagtttctatatgtgaagttagtgagtctttttgtgttactccaaaataaaggcaatgatttatttttttcccagtgccaatacaattttgagctaagcactcaaggtggatactttacattttaaagctggaatcagcaacagccctatgggaaaccagacaaagcattgacttttaaatgtagacttttaaaataaactgttttcttttggaactacaattagaatagttaatattcatccttaaaccattattatgtgtacattattgttgctattgtgataatagagaattttatttatttttatgccagcttatattgtgagaacacatttagtcagtttgggttttatcaatcctgttaatgcttgtccttggaacatctttcgcgtattcacggtttgtagttgaaaagtttactgtaaaaaaatcaaaaacaaaaaaatgtattgtttttacagaataaatttattggaatgtgtactgggagtaagatttgaggttgtaagcaaactaagttagtgtaatttggcttcatatatgtaacgtgaggtattaatgtaattcatatattaaagcaaaaattgttcacagc

SEQ ID NO: 37266 - DNA, 115791 bp, Homo sapiens
ctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaaggtaagggaaatttgcagtctctttgggattgcttatcaccagagagcagcaatcatgtaactcttgagatttttctatttcccaggccatgggaatctcctactttaatatttttctaagagttagacattctttcttactgtttttgtagtttgaaaatgtaagaaaatgaaacgttattctttagtaattggcccccaaattgtagtatagggaaaacctgtgacaccactggcaacaagggacaaggagaacactcatatcacaagcttgctctatcatggagatgcatgttacatctccttgtgtaccgaggacatgttttgaacttggggtacttatgagtctgtggaaaaatagaatgatttataacagatcttggtggtgtttattggcagtttgattaaaatcagtgtagatttccttttagaaaaatccattgaaggagagactatatagcaactaggaaaaaaataattcaaaatgtcacataaagtttgtaaaagcaatagaaaccagatatatgtttcgaatgcaatgtgcgttcaaagtgaaactaactttactctctttaaaacaattcaagatttttaatagctggaaatccacgatcacgagaatagataatttctaaagtaggcactttaagtaagcttaaaggtacaattttacatttactttcttaaggtcatcatggactgtgagcatagcacttttgccttcatgagccagtttgtatttttattgagcaaataaatttacttataatttcttaaacttgagaaagagtgattaaatagtgataaaatgtaaagaagtgtggtcaaatgtagaggggaaatagaattttattaaattatcagggggaaggaggagagagaggtaccagggattgcttcctttcttgaaagcaagaactaagctcaaaaaactgtcttggtctccctaatttgccatcagcacactggaacagaaggcatgagagaaagcttgtaagtagacatggcttgccactaaaggtttggtgacatttgaaacaaagatcgaccgtttagatttttgcatcacttccttcagtggttatttctcttcctggattgacagcagtgttgccccacaccttaagaggcctgctttctctagttatcagcaaatgatgagtatactttgcttggcatgggatgacaatctccaagtgacatttcactgtgttcctctagttttgtctggatccccaaactgaagctgactgcatcaacaacatcaatgacttcctgaaaggatgtgcaaccctccaagtggaagtaagcctaccccgggtgccttccctgttgtcatcgtttttttgctctgctaatcaagattggtagtaagagtacttgtttattttcactgtcattggccactgagttaaacagaggtagcagactggtggtccccagtaatggattgctagtctgtcttttccagaaaccagttccaagcaaaacaaaacaaaataaaaactcacacaataatgccttttatatacagcatccaagccctgtaaacaggcttccagtgacagagcttgtgtgggtgtgttctcctactaaggggaaccaaaagtgggccactgactgttggagagggtcactgtaatcctcccaagttgagaaaagaggaaaggccattgttactccttcccattaacactttagaacagaggccttgaaaagctgagagaacttggctttgaggtagaaattgtatagtaaattttgtggcattattttatattatatggatccctacagtgtgtataggaagtgttactgaaagggaggtgatacttccacacgagcatcaagttgcttaacttctctgtgcttcagtatttttatctgtaaaacggacatgctaatagccaactcatgggattgctttaagaatcaaataaggccgggcatgatggctcatgcctttaatcctaggccaaggcagaaggattgctatagcccaggagttcgagaccagcctggacagtatggtgaaatggtgactctacaaaaaatacaaaaattaggcaggcgtggtggcttgtgcctgtagtcccagctactcgggaggctgaggtgggaggatcgcttgaacccaagaggtggtggaggttgcagtgagctgtgattgcaccactgcactccagcctgaatgacagaaagagaccttgtctcgaaaaaaaaaaaaagaatcaaataagatactgcataataatttagggccaagagctccaaccttgtaagatctatgagataatttatgtagagtccttagcatagggcctgggacagaagaagtactctatattaatagactagtattagtcatattatccgtggacaaatagttgtggtttaagcatggactgtggtgctaaactttttgggttcaaatctcagttctctcttactagcagctttgtgaccttgggcatgttacttaactatgactctaggcctcagtcttcctacctacaaaatgggaataatagtggcaccgaattcataggactcgtgtgacctttttaaaaaatattatttcaatagtttgggaggaacaggtaggtggtgtttggttacatggataagttattcagtggtgatttctgagattttggtgcatccatcacttgagcagtgtacactgtacccaatgtagagtcttttatccctcaccctactcccacccttccccctgagtccccagagcccattacatcattcctatgcctttgcatcctcatagcttagctcccccttataagtgagaacatatgatgtttggttttccattcctgagttacttcccttagaataatggtctccacctccacccaggttgtcgtgaatgccattattttgttccttcttatggctgagtagtattccatggtgtgtgtgtgtgtgtgtgtgtgtgtatgtatacatattatatatatgtatattacattttctttatccactctttggctgatgggcatttaggctgggtccataactttgcaattgcaaattgtgctactataaatatgtgtgtgcaagtgtccttttcatatagtgacttcttttcctctgggtagatactcagtagtaggattactggatcaaatggtagttctacttttacttctttaaggaatctccatacttaaggttttccatagtggttgtactagtttacattcccaccagcagtgtagaagtgtttccttttcaccacattcatgccaacatctaatattttttgttttttttttaattgtggccatttctgcaggagtgaggtgatatctcattgtggtttgatttgcatttccagtgcttagtgatgttgagcattttttcatatgtttcttggccatttgtatatgttctttgagaattgtctattcatgtccttagcccactttttgatgggattatttgttttttgtttttgttttgttttgttttttgagactgagtctcactctgttgcccaagctggaatgcagtggtgtgatcttggctcactgcaacctctacctccctggttccagcgattctcctgcctcagcctcctgagtagctgggaatacaggcgcccgccaccatgcctggctaatttttgtgttgttagtagagacagggtttcactatgttggccaggctggtctcaaactcctgacctcaggtgatccgcccgcctgggtctcccaaagtgctgggattacaggcgtgagccaccgcacccggcctatttgtttatttttatttctactttatttatttatttatttatttatttatttatttatttatctatttatttatttttgctgatttgtttgagttccttgtcgattctggatattagacctttgtcagatgcatagtttgggaatattttctcccacattgtgagttgtctgtttactctgctgattatttattttgctgtgcagaaattttttagtttaattaggtcccatctatttatctttgtttttgttgcctttgtttttgagttcttggtcatgaactctttgccaaagccaatacctagaagagtttttccaatgttgtcttctagaatttttatgatttcaggtcttagatttaagtccttggtccatcttgagttgatttttgtagagaggtgagagatgagagatgcggtgagagatgaggatccaggttcattctcctacatgtggcttgccaaatatcccagcaccatttgttgaatagggtgtcctttccccagtttatgtttttgtttgctttgtcaaagaccagttggctgtaagtattgggctttatttctgggttctctattctgtgtcattggtttatgtgcctatttttataccactaccatgctattttggtaactacaggcttgtagtatagtttgaagtcgggtaatgtgatgcctctagatttgttctttttgtttaatcttgctttggctatgtgtgttctttttgggtttcatatgaattttaggattgttttttctagttctgtcaagaattattatggtattttgatgggaattgcgttgaatttgtagattgtttttagcagtatggtctttttcacaatattgattctacccatccatgagcatgggatgtgtttccatttgtttgtgtcatctatgatttctttcagcagtgttttgtagttttccttgtagagatctttcacctcctgggttaggtatatgcctaagtatattattttttttgcagctgttgtaaaaggggttgagttcttgatttgattctcagcttggttgctgttggtgtatagtagtgttactgacatattgattttgtatcctgaactttactgaattcatttttcagatctaggagctttttggatgagtctttagggttttctaggtatacaatcatatcatcagcaaacagtgagagtttgacttcctctttaccgatttggatgccccttatttctttcttttgtctgattgctctggctaggacttccaggactatgttgaacagaaatggtgaaagggggcatccttgtccagttccagttctcaggaagaatgttttcatcttttccctgttcaatataatgttggctgtgggtttgtcatagatggcttttattaccttaaggtatgtcccttccatgctgattttgtggagggttttaatcataaagggatgctggattttgtcaaatgctttttctgcatctattgagatgatcatgtgatttttgtttttaattctgtttatgtggtgtatcacatttattgacttgcatgtgttaaaccaaacctgcatccctggtatgaaacccatttgatcatggtgtattatctttttgatatggtattggattcagttacctagtattttgttgagaatttttgcatctatgttcatcaggggtactggtctgtagttttctttttttgtcatgtctgtttctggttttggtttgagggtaatactggcttcatagaatgatttagggaggattatctctctctgtcttttgggatagttttagaaggattggtaccaatttttctttgaatgtctgatagaatcatgtgacatttcaaggaattcatatatgtaaaggccccagaagagtgcccggaatgtagtaagtattctctgcatggtagatattattattagcaatgctggtagctttgccccagataaactttgcttccttcaccatttttcctaaagttagccctaggaccaggttatatctgtttcagaatattttattccattttcccctattgcctaatttgcactctctctctcaatctctgtttctttctctctctctatttatgtgtgggtctgtgtgtgtgacttttgaggtaggtgtgatgggtgaccactttatatcccttgtagaataatgtctactatggaattttcttttttttttctattatggtccagactcttcaggaaattttaaatttttctttaataaatactatgatattttcttttttattcctttttttttttttttttgagacagagttttgctctgtcacccagtctggagtgcagtggtgtcatctctgctcactgcaacctctgcctcctgggctcaagcaattctcatgcctcagcctctcaagtagctgggattacaggcacgcgccaccacgcccggctaatttttgtatttttagtagagacggagtttcaccatgttggccaggctgatctcaagctcctgacctcaagtgatctgcccaccttggcatcccaaaatgctgggattacaggcatgagccaccacgcctggccaatactatggtatttttttttttcaaataaaaacatggtgaagttgccaatgatttctgcattctaaagctgccagaaggtttacttagcttctttgcagttctaagaatactggatgatacagaaacaccttccaggttaggcattgttcaggatttttctgataactaatgcttactcctttaagcaccaatgcttaaaatattcttccactttggatagaaatatttattgtttaaaaaaattatgtttattacttttatttttttatgggacacttcacaaatttttgtgttattctcgtacaggggccatatgaatattctctgtatcgttccaattttagtatatgggctgctgaagtgagcacaagatagaaatatttctaaaatgtatgtcttaattttctctcttcttaaataaaaggcactggaaacacttttatctctttttggtaattcatgctgacctgggcattatatgaatattgtaatgaggcaatatctgacatcgtggttaagcacatgccttctctagtttggcagacctagattagaatcttggcttggtcaattactggctgcataactctgggacagttacttgacctctctatgctcctttttcctcatctgtataatggagacattaatagtatctgctgtatatgattgttttaaggatcaaatgagataatacatccaaggcacttaatatagcactgcacataaggcatacacaatagctgttttctgtggtgttattactcggtaatgttctctgcattgttgtgtgcaaaattattcttgtaaggtatatataggagccatattgaggcactcctagaacccagaaagaagactaataaaatcaatacataaggaatgagaccgaaagctgagctggggagcacgaagcagccaagaagactcatcatcttgtctgaagcttccaggtagctggaagacagacttaaacataaatatttgcaaatgtccctggatagagtctctctcgggcccaaagtgcctggcacagtgcctggcataggacatacctaatagatttttgttgaccctataaaactgtagatgtacaaaaagcaagaagagcagggcttgactgttgcttagaacacaatattatttatctaaagaaagcataccggcttgaaattgtcagcttggaaatgcagaaaaatggagccgcagatgcagcaccgtaccgacaaattgagtactgggctctggggcatggtgacgacattaaaaaagctgttgccttctggtcctctgggtggccagtcggcttctccaagtaacccccatctgtgtgttctcatatggctacaatgtcttagggtctttagaggatcacacatttagtaactgatcaggaaagtctgctgagacatctgggaacaaagtgctctcggaagcaccccaccaccttcttgatagtgtcctttgtaacacaattttttttgttgttgttgtctgtttgtttgagacggagtcttgctctgtctcccaggctggagtgcagtggcacaatcttggctcacggcaactttggcctcttgggttcaagtgattctcatgcctcagcctcccaagtagctgggattacaggtgcctgccactatgcctggctaatttttgtatttttaagtagagacggggttttgccatattgtccagcctctcctggcctcaagtgatccacctgcctcagcctcccaaaaggctgggattacaggcgtaagccactgtgcctggcccacaaaaatttattaattagacatttttgttttttactttcaatttttgtgggtacatagcaggtgtatatatttgtggggtacatgaaatgttgtgatacaggcatgcaatgtgtaataatcccatcatggagagtggggtatccataccctcaagcatttatcctttgtgttacaaacaattcaattacactctttaagttattttaataagtacaattattattgactatagtcaccctgttgtgctatcaaatgggccttattcattctttcaattttttttgtacccattaaccattcctgcctccttccccaatatacttctcagcctctggtaacctgtcttctactctctatgcccattagttcaattgtttttatttttagatcccacaaataagtgaggacatgtgatgtttgtctttctgtacctggcttatttcacttaacataatgatctctagttccatccatgttgttgcaaatgactgattctcattcttctttatggctgaatagtactccattgtgtatacataccacattttctttatccattcatttgttggtggacagttaggttgcttccaaatcttagctatttgtgaacagtactgcaacaaacataggagcgccgttatctcttccatatactgatttcctttcttttgggtaacatacccagcagtgggattgctggatcatatggtagctcaattttcagtttttcgaggcacctccaaactgtccataatggttgtattaatttacgttcccaccagcagtgtatgagggttcccttttctccacatcctctccagcatttgttattgcctgtccaaaagtttttaattttgatgaagtcaaattcatctcttttgttgcttgtgcttttggtgtcatatctaagaaactcataatcaaatgtcttgaagaatttttttcctgttttctcctaagaataatatagttttacttcttacattaaggtctttgatctattttgagttaatttttgtatatggtaggaggtacgggtccaaattcattcttttgcatatgcacatccagttgtttcagtaacatttgttgaaaagacaacattagccaattcctccattgaactgattaatgtagctacgtagtaagttttaaaagcgggtccttcaactttgttcttcattttcaaaatcactttggccattctggatccctcgcatgtccatatgaattttaggatcagcttgtcaatttctacaaaaaaggccagctgagattttgatagtgattgtgttcaatctatagattgctttggagagtgttgccatcttaataatattaaatgtttgaatccatgaacatgggatgtatttccacttatttgtcttatgggatgtatttccacttatttgtctttagtttcattcagcaatattatgtacttttcagtgtacatgtcttatacctgcttggttcaatttattccaaaggattttattatttttggtgttataaaaaaataggattgttttcttgatttggtatttaaattgttcactgcaagtgtatagaaatataattatttttttgagacaaggtcttactctgttgcccaggctggagtgcagtggtgtgattacagctcactgcagtctcaaactcctgggctcaggtgattgtcctacctcagccacctgagtagctgtgaccacaggtgtggagcaccatgcttggctaatttttgtattttttatagatacagggtttcacaatgtagcccaggctggtctcgagctcctgagctcaagtgatccacctgtctttggcctcccaaagtgctgggattacaggtgtgagccacggtgcctgccctattgattttttaatattcatcttgtattcttcacttccaagaacttattcattagtttgaatagttttttagtggattcccatatggttttcttatacaagagtatgccattggtgaatagagatagttttacttcttcctttacaatctggatgccttttatttcattttcttccctaatttttctggctggaacctctggtacaatgtttaatagaagtgatgagagcagacagtctttcaccattgagtacgatgttagatgtgggtttttggtaaatggcctttatcagattgaggtttctttatattctgagtttgttataagtgttttgttttgttttttatcatgaaaagagttggattttgtcaaatgctttttctacgtctgttaaaatgatcactggtttttgtttgttattatatttgtatgctgtattacatcaattgattttcatatattaaatcaatcttgcattcctgggataaaacccagtagatcatgttatatatgcacatagaaatttgtgcacatcagtgattattcttgaaggatctttcttcacagaaatgggattactgtgtaaaattgtgatagataatgtcaaattgcccttcaaaaatgttataccaagttacactctcagcaatagtgtaaacagtgtcttcttcctgtccctggcaacactggatattatttgtctttaatgtttgctaaactgatggatgaaaatggcatttcatttattgctgtaatttgtatttcatgattactaatgagtttggacatcctcttatccctttatagtctatttgtatttcctttttgtgaaccaaatatatctttcttactttcttacagaatggagaaggcagggaaaatactcaggtcccaagtgaagtttccagaatatatggaagaatcctcctgtctaggtagagggtcactgatgtctctcaacaacacaagttctagcaatggcagttttatttttgtgttgcccctgaagttgctgagagttggggacacctacaattcttccgatcagtcaagaatggcctgggtagtacctctttgattgcattgtcctggctacaactacatgaccgactggtctctgaaagctctaaacctatggttttcctgttagccaaccctttcctctgccttatccccagaaggtaatctgcctttgtcctcttccaccattactaccaacccattgccagggacaccctaccatctcctattctgctcctgagccaagtttattatttatttatttatttttatttatttttgagatggagtctcgctctgtcacccagctggagtgcagtggcgtgatctaggctcactgcagcctccacctcccgggttaaagtgattcttgtgcctcagcctcccaagtagctgggattacaggtgcccgccatcatgccccgcaaatttttgtatttttagtagagacagggtttcgccctgttggccaggctggtctcgaattcctgacctcaagtgatccacctgcatctgcctcccaaagtgctgggattataggcaggagccaccgcacccagccccaagtttatttttttttaaagatattttattctggaaggatttcactgaatgtatatgagattcaattagtacttatttcactttctttcttcctccttccctctcttcctcctctctttccccctctcttactctctctccctctctttctccccctctctctttctttctttccagtaccagctggtagcagtatgtttttttctctgcccccaccccctcattccctcctgtctccctgagtcactccatctgccttgtcaccggaacagcaggggtgccctccccaaagtgaggcttgtgggatggacgatttgccatttcccaggggctgctctgcagggaagcagttctgaaagtaaggcagctctactaatgatcatgagtcaagactaaatatctagcagcgcggtgcctcctgggaggagttaggcacaaggcccggcctaaccactacaattaccagtagttgtaacgggtatcagcagatcttgcttcaagccctgaccctgccacttgtgtgaagtcaggatctcctttcccaggcctcagttgagtcatctgtaaaatgaggagactagagtaggggttgggtaatgtctaatggttgtaatgtctgtttttaacttgcccatttccatcagtttccgctaggcaaagctttgcatatttagctgctcagttggaactagtaggaagaccaaagaggattttggcaagttcttttcttctgttgtgcaaatctgacatgcttaatggaatttccaagagttacattaaatgtcacccatgagtctggctatcctaatgttttacagattgcatcgtatttctgtaaaaattagacattgaataagattttaaatatttcccatctatcatgaacattttcgttctctctcaaagagactatttgatttggggcctgttatcagagaggccgggaagggcatctaggatagttggaggaagggtggtatgtgaagggcctctggagagccaacgcttctcgggtgtctcagcggctcaccatagagtttgggggttctgagttgcatctgggggtgagggaggaagcaggccaccagaaagggctagtccatgagtccgggaatcccgcccgaagctctggcagtgacccgcaacatgccaggcaccggcagccctcgggtaggggctgaagcgggcggcagcagcatgcgcagtgtggccgccgcgggtacaccgcggcttttgctgctgccacagctaccagggctgctgctgctgctgctgctgctgctgctgctctgcctgcgccgctgtcacttccagttcctacttctgcgatccaggtccgggtcactgcttacccgctgctggcccagtgcctccaggccgctttccctccgctgctcggctccggctgcgggcaggaggggaccggcgcgggtagctgagcgtggtctggagaagcttcgcgggctggctcccccggcagtcgctcccctccactcgccaccccgcgcaccctcgcccggctcgcagccagcgcacccagcggggcgcgcctccggcacccccagttcggccccgcgatcctccgcccgccgagcggcacggctatggcaacaagaacttgaggacaagactctgacttccctttagattaaaaaacaatccctgggctggagaggttgcgggcgcggcacagagtttggagacgggcgccccctcctcgcccgcgtccaggcgcaaagttgcagccgcccctccccgctggggcgagcctagcccagctctccagtttcgccctggtggcggccgcgctcagggcagggtcccagctccggctgggttgatctgttcccgcagccttggcacaggcttgcccgcccgctcgccggccccgtgactcgggagggcgaacggcttccaggaggcggcggcggcgcggctggagtgagggagcagctggaggacaggcgggcagcggccgagccaggtgacctgcctgggggcaaaagggtcaggggaaggggagcgcgcgagggcccgggggtgggtgccgaaggaccccctttggagaggaaccgcccttcttccccactgccgtggctcgcagccccagctgcggggtccgttctctgccagggcctcacagttcgctgagatccagggtgccgggaagggggagatgagggccaaggacgcagagcgaggacgcgccaaacttaggggcgagttgtccagctctggccgcaaggtttgcatccgactggattctttccttcccccagaaccagagcaggagtcaacagtaccatttttaatactactgtgatgccctcccaaccccgagcatccatacatttggagatgttttctgcattaagtacagagatctgtcgcaggaatggtttgtagatggaaaagacctgtattctacaaggtgttccaaagtgcctgtagttaattacaagttttcattttccagtcatttaggaacccaacaggtatttgagctatttcgtttcttagctctgcagcggagagccctcaagtttatctctgcctcttcaaaggtcttatattttcatttttgatttgttattgtttttggatagaggggtaactcacatgatatttttcccttttcttaatgtgtagtgggagtaaaaatacagtaaatgaatatattttcctctgcaattatgtatattttggtcaataaaaactttgcataacccccccccaaaaaaaacctcacaaaataggataaatttcagtttatgctctgtaaagtattaataattttaaaggcaagattcaaaggttcaaactgtttttttttaaacttatatttgcctggaaaactcatagtgtccttggacttcctatcttaattttgacattgaccatggtaagaggatctctgatgacatcatttgctccagccacagtctggaattctgtgactgagagcacctctctccaaaatgtaaggcctgggcctgcccttgtgcttcagctgaggcatttccaaggatttctcttcagcaaagtattatgctacatgccaggcaatgctgcagtcccttcttacataataagccagcttcaggctggtgtactctttgggtgtgcttagagcagttaaaacaagggagtgttctgtcttagtctgggtgctgtgcagatgattggagttttgaacaaagtaaatttccagctactattctcatattgcatttctttggtgcttaattttttgaatgccttctagttatctgaaactccccgtgcccttgtaaaggatgtaggagagatggcattactttcacttgacaaagaaacagaaaagtttagttaatcgaagtcatacagcttatcactggtaggatcaaaactctaacctggacctcctgctttcagcctaggttttttctttgttcgtttatttttactaaaatgtgacattttatacaaaagtgttttatgtggcacattttatggatggtatgtcttccaagctactaattttttctattctttttgcctactcacatctcagccttgtctttgcttgtgcagggctggcgctgttcttaggggtaaggacaggaggagagtttttcaaaggatggtctgtggtttctatttacctacagtctgcctcttctctactcacattcagggagagcaggtgctgaatagagtgagtagccagggcccagaaatttctgatattcatttgacatcattagtccaagtataacattacttcaatctttacaaagaaactcattcaggagaggaaattgaagagtatgagttttgttcttttatagcaatctgtttatcactgtgcttaggaccgtagatgcaaaggaggaaaaggagttgagtatctaccatttctcaggcacctcctatgttccaggcactatgctaggtgctttaaatctattatcatatttagcccttgcaacactcctgggaggtaggtggcattgtactcattataccctggtggaaaccaaggtttggagatgatccagactgatgcctcacactgccagtgcaaagaagaaccggaatgtaatcactgatgtacctgactccagaactcattccctttgccttgtgctaggctgctgttgcccccaaagctattgataaatacaggaacacctagctcctttgttttcagacatggctgtacattggagtcacttgggatactttttaaaaatacaaattttggggtcttataacccagagattttgagttaattggtccgcaatgaggcccagccactggtattccttttttaaaaaaatgcttaaatcaactttatatttacattcgggaaattgcacaaatcctaagtatatagtttggtgaatcttcgcaaactgacacactcatacagtctgcacccttattaagaaacagaacaggattggtgcccagaagctatcctcgtgccccttcccagtcactatgcctcaccaaggggcactactatcatgactatccaccactatcgtagtagataccctgccttcccacctgttttggtactctatatgagcggactcatacagtatgtacttgtttgtatgaggtttctttcactcagcataatatttgtacaagtcacccgtgttgttgcaggtagtagtggttcactttttttcttgctgtataatatttcattgtatggatataccatgttttgtttttctattcacttgttgatggacatctacattgtttccagtttttgtttgctgtgaacaatgctgctatgaagatcctcgtgagtgtctcctggagaatatatacacccatttctgttgggtttatgcattacagtgtcactgctacgtcatagggtctgcatgtgttcagctttagtaggtactgtccagccatttcccaaatcagacaagccttgtgatttttttttttttgaaagctctgcaagtgattctaatgtgtatccagagttgagaaccatttccctggtttatccagcgttcagcaacctagtgacctcaactgtctgccactaagctgagaaccatacagaaggagataccaactttcttctcagcctggaatcttctggacagtcttctcagcaaaattgggcagcttacacttattttcccataatcccttgtgccaagctacctttatactgctcgtccacccttgctttgtttttttttgtgaacacatctgctagtctcagaacttttcaaaggtaggaactggagcctgatcttctttattttatttctttatttattttgagacagagtctcgctctgttgcccaggctggagtgcagtggtgcgatctctgctcactgcaacctctgcctcctaggtacaagcgattctcttgcctcagcttcctgagtagctgggattacaggcacataccaccacgcccggctaatttttgtatttttcatagagatggggtttcaccatattggccaggctggtcttgaactcctgacctcaagtgatccacccgacttggcttcccaaactgctaggattacaggcgtaagccaccgtgcccggccgtgatcatctttataaccctagcgcccagtacaggacatggcacagagcaagtgcttaggaagggtttgttagatgaaagattgatagaatgactgagtactcagagaagatctgggctgcaaaggagacatcccatctttgcactaagaattatgtactttattcataggacactgcctcaggcccttgctcaaagcctaattgcttttacttatctcagcatgttagcattatgggtaatctggttgctcaccctgaaactgattagaaatagcagattaaatgagatgaggtaaggtatgtgaaagcacattgtaaactggaaaatagcatctaaatagaaagttgtgataaagggaaatgaggggctgccctagattagatacactggcaatggcagaaactctatatatctatgtacaacgtggaataactgaaatcaaaagcatgtcagcaaaggagacagaaaaactataaaaagcagacccccaaacacataactctctggggacttttgatgtggtgtcaggcatgctgtgtggtctagtcgctagaatatgttccttttcctgccttggtctgggtttgattcctggttagggcagccttttttttcttgagaagttgtataccagtgcagggactatgagcttgagctttggacatggactgacctggttggccacttattaggtatatgctaacctcctaggaggtagtagtaataccacttattaagtatatgcttctggctgggcacagtggctcacgcctataatcctagcactttgggaggctgaggcaggcggatcacttgaggtcaggagttcaagaccagcctgaccaacatgatgaaaccccatctctactaaaaatacaaaaattagccaggcatcgtggcacaagcctgtaattgctgctacttgggaggctgaggcaggagaatcgcttgaacctgggaggtggaggttgcagtgagccaagattgtgccactgcactggagcctggacgacagagagagactctggttaaaaaaagaaaaaaagtatatgcctcttcctagggttaaatgaaagaaagcaagtaaagcacttagcaccgtccttggcactgagtgaactctcaataaaagctagttcctaattggaattttaatatatcccagtagatcagtgttctgggatatattagataaaaaacattgcattatttttaaaaaagttcacttagttcagttatggtaagctaactctgtttaagaggtgagtcattgatttttagaaagatttccttttgaaaatttaacatttaaaaaaattggaagggcaggctggcatggtggcatacgcctgtaatcccagcactttgggaggccgaggcgggaggatcacctgaggtcaggagttcaagaccagcctggccaacatggtgaaaccccatctccacaaaagtaccaaaattagctgagcatgatggcgggtgcctgtaatcccagctactcaggaggctgaggtgggagaatcgcttgaacccgggaggcggaggttgcagtgagctgagatgctgagatcatgccattgcactccagcctaggcgacaacagcgaaactccgtttcaaaaaaaaaaagaaaaaaaatggaagggtaaactgtgggctttccaagggttctgaggttttactagttacatttgcaattgagacagggctaaaacttgaaataggaaaaaaaaatccagccattttctctctcagtactatgctctattcggcagagaccacttgtttttggcaaaatgtttttaaaaataaagtcaaaggtaaaatcctcacatattttctaatacttaacacatctctagaaggcaaaacaaagttgaatatttctgggcgtcttagatgaatagtgatgtcatacttggcctctgttctccatgcttaacagcagaaattaatccttcaacattattagcatctttcactcactattaaagtgctttcgtttctgagtttgtctctgtgcttttcatcatagaaaataattcaaatttagattacagtgtgttgaaatatgtttaaaataatttagatattatatttaattggttttttatattttatttggaaggctacataaagacagtttaaatttccgtgatattgcagcccagtgatatccatggaacagagattggaacttttaactacagtttcagacaatatatgtgcaatctgaagagttttaggaactccttgtaagagttcttgttctttccctagcttattgtcttgctgttgttctcaatgcttagcatggtcaatttttaactgctgaaaacaatttgtgtatggtttcctttataacagctcaggactagaaatatatttggggatccagttgtaaagaggaactggagaagacaaagcaactgaattcttcagagactatgaattattcagttgttaaccacagtaacttcttgagctaccattttgtgttctaataatagaaacagtttggatggattcctctgggtattgaaaaatcagatcttttcattcttttctagtctatgcataaactagaagaatgtgagaaaagactattttcagttgctcatgtttacctggatgaactagtttaatttttgtcttttaaaacagacatatttattttaaaattaaaatagcttgaaattttaaaatacaccccaaagcaagatgatcgtttaagttaagttaaacaatacaatgaatggtcttttatttttggtgatgattgccaaaaacctcttgccttcaggaaataagcaataaacctgatgaatttggcatagttgagggggaaaataaaaatcaatggcttctatttaaaaaacacagtatgtaatatctaaaaaagaaaggcattgtttctgaattggggtgaatgtaccaaacatataccaaaaggaaggcattttgttagaaaatttgattaattattagaatcttcctgactggagatgtaaattatcttgttttaaatctaactcactctaatttggttttaatgttgactgtaatccaggctgtttctggggacaacagaacacaatatacctctttattcaaaccacacaatcttggccagctattccctactccagccccattctaacttggtcttattgttatcattgaggtggccctcaaggatcagtctgagaggtgatgtgatgttgccagcacagcataaggtatgcagagcgattggtgatgacatttggggttagtaccaagaggaaatgcagagttggtcctttgaattgcaaatgaggaagtgtgaaggcacttgccagtttcttagggccctccctttaccagttttttagagggggttgtttatgtccacttagtccagaagctactctgtatctgcatttcaacatgggcaatggcacttcctctgctgtcagctggaagaaagacctatgacactagatatctgtccgattagctccaggctttgtcataccctggcaaactgggccttatcacacaaagagatgtatgggcttagagatgtggatcatccaaaacagcatgtagtcacgtatcatttctattggacttctggcagaagatttaccttcctaattaagttctacttaggcaaatctggtaaaatccaagctttatactttcttggggacttgaatattattccagagatcagacatgtcaattgagtgagtgaatagggcaacagggaaaagaaggaattaaattaaggtgagataaaatgcagcagtttgcaaagcagcaagtgaaactattattaaggacttgtctcaccctcaacaataacaaagatgtttccctacttcttggaagcatggacattattttaagaggcttttttttttttttttgacagagtcctgctgttttgcccaggctggagtgcagtggtgcgattttggctcactgtaacctccgcctctttggttcaagcgattctcctgcctcagcctcccaagtagctgggattacagtcatgtgccactatgtccggctaattttttgtatttttagtttcactatgtcgctcaggctggtcttgaactcttgatctcaagtgatccgcccccctcggcctcccaaagtgctgggattacaggtgtgagccaccgcgccagccttaagaggcatctttaaggtgtcaaactcttaacatcatttatgaaaagccctgcctgtgaagcaggcctgaacactaatttgtatgttcttcatgaggaggtctccagcaaaagagaggtatgtactaataatttctgagaaatgtatgcagatcaggagactgcagtctttcactaacaaaagaagtttaacaacttttttgtgagaatatacattgtgatagtggaaataagcgtttacactgtttgtataaccactttgcattctctgaagaaggattggtatttgggagtgtgttgtgtattggggcaaatcttgatttgagattaaaaaatcaccttcaagtagagacaacagaatagaaaatggttttagggctaatgtacctgtgggtgacttcatttgccagattttatatagggttctttttatttctcatcttaaaacaaatttatgtattactgcctggcatagacaccaggtgttcaacaaatatttgttgaatggataatgaatgggtatttgaatggaaatgaacttctaaaatttcattttagatagcttgtgtatttaagagtctacatgtagatggtcaggagttgacttttattcataaaaatgactctttaatgggtaaaaatgaggacagaaagaaagctgggtttcccctaagataacattactttatgccaagctagggtacttgtttcaagttttttaaaaattaaaaaaaagaaaattaaaggtgtgagatactagctcctgtgatgtcatatggaagcctttttctacttttccagtctctaggctacttcttatttcttctattaccgaaactctcttgctttcactgggctttcaaggtgtgagctcttcatgtgaggattctctgactgtgattttctccaaagtgatctcaggcagtaacttcatttcttttcggtgaggtaaatgctttgtcagcattttaaaatcatattcttaaaaaaaaaataatttatttttggccgggcgcagtggctcacgcctgttaatcccagcactttcggaggccgaggcgggcggatcacgaggtcaggagatccagaccatcctggctaacacggtgagacctcgtctctactaaaaatacaaaaaaattagccgggcgtggtggcacgtgcctgtagtcccagctactcaggaggctgaggcaggagaatggcgtgaacccaggaggcggagcttgtagtgagccgagatggcgccactgcactccagcctgggcgacagagcgagactccgtcccaaaaaaaaaaaaaaaaaaaaaaaaaaaaaaaaaaaaagaatttatttttagcaggtgatggaaaatatatgagccttgatttatcaaattctactttaaaaaatttgccttttcctcctctctttccttctcggaaaggcatgcccaaagggcaggtgcttctggtggaagacatacctgtttgaattttagactgggagagaaaactgacacttagcaagaacttgtccaatgtctgtaaagtgagcaccatgcctggcactgtgggctcctgcctattggacagaggcagcatgtatgtgtgaaagagtggaatttaacagcatttagcagtgtatggttaggtgtccaagttagtggttccagaatctagagcctaaatgcaagaggaattcagaaatagggaagcctgttgtgtactgaggcgtagtgtttggggaaaacaccatggaagggagtgatttggattgggccctgaaggatagctagcattcagatgattgagggaactttctgaaggagaagtataaatgtcagagagaggcacagtgaagaaagaagattctggagcatataaggagatgatggtgagaaacgatgggcctgctaaggtctaccttagagatgcttgagaagaaattattttaaatttatttattattactattttttgagatggcatcttgctctgtcatccaggctagagtgcgacaggctagagcgtgacaggctagattgccgaggctagtggcgcgatctcaactcactgcaacctccgcctcctggtttcaagcgattgtcctgcctcagcctccccactagctgggattacaggcgtgtgccaccacatctggttaatttttgtatttttagtagagacggccatgttggccaggctggccttaaactcctgacctcaagtgattagcccacctcagcctcccaaagtgctgggactacagacatgaaccactgcgcctggccttgagaagtaatttgaatgctagtctgaagagggtggacttgatcttgggttatattaggctttttattggatgcctttgctgtgttttgagagacatgagtgctaactaaaagcaccatttctgatgtctgtgagatctgagctcctgaatgcccacctaacagtgtttggattgtttcctaagtgcaaatcctgtttggagtaagttggagcaggattcactaattaatttatgtctgttaggcattgatgagtgtctctgaaaatgacatacttttcaaaaagtgaatcacacagatatataaatgggaagagccaaaagtctttgccaaatgaatggctgaaggtaatctctaagtaaagagagaaaataataataactttggcacagcatcctttcctccaagtttagcaggtgttaggaggattttgggcatgtgaattgtagtctttccaattacacgttaccccttcttgctgctggtgagttgctttgccgtgtcccattgtgctctggctgtgagttggagctagttttagagcataggcatgaacaggggagggtggcttgtagtgtttgccatttattcagttttacaacaaaaacggttgaaaatataaccaattccagaaaaagcagtaaaatcccacagttctttgcaacttctcttctctatgataatgaggtcatggtgctttgtgatggcatttagaggaacctctattacctgggacaggcaagcagttgcagatgttgcccacactcagcacacaacttaaaaaattaacaaccgtagagtctgaagcacctttggtcacctcgtggtcacagagcttaattttgctgatgagcacaggtacatctaattttagatgttacatgtttcctggaaaattgcgtggagattgttttttttctttcctaagtgatatctctttctgagtttattatactttctgcaatactttttcttcaagtatgattaatcatctattgatgagaacagctaaactctcattaattaaccaaatatctattgagtgcctactgcgtgacaggcactcttctagacactgaggatccagaagtgaaaaaaaaattgacatcatggggcttacgttctaggcataatttacctttataagtctctctgacagagcatcctgtcaatcaaccaatgaatggttatttatcaagtatttcgtgtatgttgaatattggggccaggtctgtgggggaatgcggacttcaaagagcctaccttttaataggaaattcaggactaatctcagtacctgcataatgaataaagaatattgggctgatagaccactgacagcttaaatttacaacatctctacagactataaagctgtagctgtttggaaaaaagaaacatgaaggtaggtcagtgaggacattatggatagcaacaggtgatacttggaagggctgctgctgaaggcgactagcagtggctcttttgtttcatggccctcgtttctccctagtctttgtgtggggctatttaccaccagtctctgctgtaaattctggtaggctctggggctcctaccctaaatcttagtagctgctaggaaagcagggaccaagggagccttctctccataggtgaggctcctctctaactgcctggattgttaaacaggcacggaggagctgctgactactgaaatttctgagggtattctcacggacttcatatatttaccttgattctctcatcactaagagttctaaaataaatagtaccctgaatgtctagggcatttgttcatcttttatatgaagggacaaggaaaaagcataaaggatgttggacattgatttgggaacacatgtctggccactcttcaatgtaaaaacaaattattttccaaaagttcatttttaagtgattattagggacacagaaaacattttcccatagaaacaaggctcaacacggtgattatgttttctggctggcccacaacagcctgttgaatacttaatgtggctgaactatagaactcacagaggctaagtggcaggtgtgatgctgtttctgggaaaatgtgttccgcattccaatttggaacactagggagtcagtccctgtttctaaaggggtgggagtgggggcattggggaagacaccctcatgtctggcacacagatgctccagcagctgagagatcacccatccaccccacaccgcaaaactggcaaccagtgtgcttttgcaaaggctctggtgacaggagcacaggaggaggggtgggagcccgccaagccacaatggctggctgactgtgaggcagctgagtctaggcctcctgcttcctgtccttggcttggcaagggctattgacaagagatatttcatttttccctttccttcatgcctactctctttttggtgagattattcaaaaccagttgttccttcttcttttttctttttcttttcttttctttcgttgttttttttttttttgaggcggggtttcgctgttgcccaggctggagtgcagtggtgcaatctcagctcgctgcaacctccgcctcccagattcaagccattcttctacctcagcctcctgagtagctgggattacaggtgcccaccactgcacctggctaatttttgtatttttagaagagatgggtttcactatgctggccagtctggtctcgaactcctggactcaagtgatccacctacctcggcctcccaaggtgctgggattacaggtgtgagccattgtgcccagccatcagttgttctcttttgctctccctttatttaatcctgtgactggccccactaagatgcctatattgttcttcattcattcccctcttacctgaacacttaatactcaactaaagtctctgttatagagaaaggggttctcccctataggagtgctaacaaggaagaatgggagtcctatggtgatgctgaggtagccgtcagggaatgagatttgtgacttaatgaagagtgagggagaaagctcagatcttggcttctgtcataggagctccatggagctgaacttcctggctctagattctatgaggttcgagtaatctaggagtccatattagttatgtaaagtgactttatagaaatccacagagccaaaaagaaaacatagagagttaaagctgtccatgatcacagtccaaatgccacgatgcagtggcagcaagataaagccagaatttataaataggtcatttaaaaatgacattttgaaaaatcagcttgtaaacaggttgtaagcatgttaggctgcaataccctagactctctttgctctgattctgtagtactcaacacatttctcattataatttagctcaccagagagatttctctattgggagagagtgccctggccagaaaatgggagtatttaatcttcttagtgcttcatttatttttagtaaaaattaagaaattggccttttggtttatgcattggccttttatgagcttggctagtgtgagtccattctcaagagccttgagaactgaagacctgattctgggccttggggacccagccaagatgctgcctttaaaagctcctatttagatgatggaccacaagacctctcactgagctcctttgctcaaagacactttccagatgggaaatggagcctcataaaggtagtgttgctttcctaaggtcctcacaactgctcaatagtgacaaagctgagattggagtcaaagtcttctgactctcacatcagtgctctttccaatacactgtatgttgtttcagctacaggcacaaattagatcttggagagaaagggaggaaataaaagttgagagcaagatttgctcccttaagtttggtccatatcaaataggaacagctattatttaaaaccaggcagagtagaaatgccatccactatattctagtaagtggaataccagtgggtaatgaatccaatttctgagctaagagcattatttgttgctgactttgtgactgcttttagtaggagctatgtgcacacatcccagatcacgttcacagggccaggagcggtaccacccagtgaaatatgactaagcagctcagatttgcttgctctgttgcactatgtaatgacatttccaccaaagttcaggggttaacagaggcagtgtgctcagctgtgagaattaaagaatgtgattcaagatgagctaagttaatttaagattttgttcaataagagcaataagaacaaggaagagctggaatgttcctaaatatttggaatcttttttaaaaaacaggcttgaaatataagctatatgtccttgtggtcccaatgtatcacttgcttttcagttgattagacttttaactcttgagtaatggaacctattataatcacccccaaccttaaattacctttaaatagcagttgattgggtgttactgaaaccacatgacattaaagatgaccagttctgaaccagggtagggtatgccttcttttcttaactaagatgtggctagactgctgtgactggttaactcaggtggttagagcatgatgtcaagaaaatcaggaggctaggtgtcattgcacgtggcacagatgttttagcttggttctgtaatcacgagctggacccctaccagaccaggacctcacaaatatggatcgtggctcacgaggcagacctggttcaacaaataggaggagcttagtgtagcttttcccctcttttggcaaatgtggccaagtgcctcctaggtgaaggctgacccttgaaatgggaaggacagcacaggaattaggcaaggcccctgtggagacagtcttgtaatatggaaaattttctctttgctacaattagttgaattaatcattttagaggctataacaaactcgatgcagatgatacagatgctacttgtattgacagaagcaaaggatttcttttcgcatacagactcatggattgctttttcattttttctctatgtctcatggaaacataaggtgtacatgcagggctacaatgcccctcagagcattttcttgtgtatctttattggctccatcattttcctgccctgtgacttaactactctgagtcttagtttactcatccgtggaatggggaaaataattgtactgacatcatgggcttgctgggagaatcaaatgcaaataaaaaaatatatttgtatcttagtctgttcagaccaccagaacaaaaagccataaaccaggtagcttataaacaatggaagtgtatttctcatagttctggaggccagaaatccaagatcaagacatatttagtatcctggtgagggcctacttccctattcatagatagtaccttctctctatgtccttacatggtggaagggacaaggtagctctctggggcctcttggataaagtcaacaatcccagtcatgagagctatgccctcatgatctaatcacctctaaatgccaccacctccaaataccattatactggtgattaggtttcaacatatgaatttgggaagggcacaaacattcagatcatagcaatatgtatgtgatgtccaagcgtggtgccaggaacatagcaggagctcagtaaatcagtaaacagtagctataagataagtgagggaatggaacagggagttgggaaagtttattctcatatgcttcctggctttttgcagtttagggaaagtgtcataaaatagcatacatgttgaaactgagaactactccaaaaggttctatttgtaatgctatagaaatattaacttcttgcagtttacattggcagatccccaataattcacaattaacacctggtgtttagtggtttgcaaataggttttgctgtcattggggatatctagaataaaaagctgtagggaaacatttaaaaattaaatgtctgggctgggcgcggtggctcacgcctgtaatcccagcactttagcaggctgaggtaggtggctcacttgaggtcaggagtttgagaccagcctggccaacatgatgaaaccccatttctactaaaaatacaaaaacaaaaacaaaaacaaacaaacaaacaaacaaaaattagccgggcatggtggcaggtccctgtaatcccagctactcgagaggctgaggcaggagaattgcttgaaactgggaggcggaggttgcagtgagctgagatcatgccactgcactccagcctgggggatacagtgagactctgcctcaaaaaaaaaaaaaaaagtttgatttcatctactgatgtaggaatgcaacttaggttggctatatgtaaatacttaaaatatctttaataaagtttaatccctgtctgtcctattggttagagtaaatgtttttattgttgttagatttgaacattgcatcatctgattgcaggaatgataccttgacaccatctagccgtagtctaagaagtaatacttttttcttgtctgagtcacagtagtggtaagatgaatggagggagggaatcctgctgttcatctgaccttcacggatctaactggaactaactggctttttgtgcaccaaaataggtataaagaaagttcagctaatctgggactcagtcacaaaccagagacactgaacagactagtgaggcttgcacagggtactagaagatgagtatcatcatgactttgccatgatttgactttgactttgaaaaatttcattgaaaatgactttggaaaattacatacagcataaatgtgcaaatttacattacctttttaacaagttccagtgctttgcagacagaaaagggaattggttctctattttggatgtataaatgagtgggattagtcctagaaaaagtggtctgtactttaatctacctttccttgttcttctcacaccctctctacattggggaattctcctttgctttctcctatttggggaccagagcccttagtctttctccacatcaacatctctaaacttggtctcacactgctcatttccactaagacataaataactgatagtggctgaaaatgttgtgatccctccagataatatttccattttcataggggagctctctgaagtgcatggaagaaagatctagggtggaattttcaatatcattcaatttaggacttagaaggtatagtgtggtgaagggtgtttgtggttgtatctgattctccagctactctgaaataataatgcttaggcgttgctttctctagcagttcccagaggcttcttccaactccttcctctgtagtttctagtgcctcagaataggcttgcagcaagaacagtgtccatggataaacttgagtatattggggttttctcaaaagagaaccgagtacagttcaggaaacttccctcaagcagatgcaatgactcttcttgatgcacatttcattttctgattagtttatttattttcaaaatcagtcaagtacttgtacaagtgaataataccagtgttgccatgtataggcatttaataaccctggataaggaacaactaaaaccagagggagaggttttttatcacaacttttgctctcatgccttattctgctaatatttaacttctgcttattattttagatctactcatctctaccacacccacccaaaacatgtatccacatgcacacacacatgcacactcccattaggactgatgggctaaaaacaagtgattttttttgctttgctactattttggcatacatgtcattaacattttcccagttgatcagttctaagggagactcaataagtctgaaatccccggagatactagacactctctctagtctattgcctcttgttcacccaggctttgacaaactaaaacaaaactcttgtcaatgtatttctggaaaagtttgaattttatattgtagcattcagaaatatatttggaatgtgttgttgtttaactctttagtaatattagcattactcttttaccagaaatatattaatgtctcatttttagatgcatctgggctttttggtcattttaactttgaatgcaaaatattcattgattaaatgaataaagcagtgaatcctagaataggcagacttgtgtaggtttgcatttgcatgtatctttattgaccccccaaaacgtgaaaaattgatattatatattttcactctaaaaacagattataggttttcaagaacatgtacaaaaaagatagaaatttgtcttgatatggttcccagaaaatatgcagcttaaaaatggaacaaatggctctacctaatgggaagacagaccctttaaaatcctatgcccattaccaatcatgtcccatatgaaaaggtacattttatttccatcaccacatttggggaaaaaatgatgcaatctgttttctttaagagacttctagacatcctggaacaaaatgtttttagaaggggcatttccatccagaaggtgggcatctggttaccttcagatatgcatacttacattgttggctggcaaattaatagattgtacctgtgcatgagaacacttctaatttcaaatatacatatttgagactcaatatattttaacacactgactacatttcaaaggtaacaggtaaattgtattgaaaacaacatctgattggtatcttcactggggacaatagcatatcagattgacagttgactggtaaagtgaaatgtatttccttaatgtgttttttgccaagagttgagtagtattagacaggccagaggtcatatttgggaaagtcatctaaagccaggaagagcccataggcccaggcaggcaaatacttgaattcatgatgagctgagaggggcaaggtcaaacagcagaaacagaactgaagctgggagcaaaaggcagacctgggcagaaagtttgggcaacatggaattgggatcctaggcagttgggatgcagcgggtggcagttgggaggaaggagagcagagaaaaaggcacttttgacagtgactcaactaggcacagctaataaactgtacagatgcaaccatgtcaaaaaggctccacctccttatttatggactgtcgaggacattatgtaggtgatgggcattgattgtaacccatgcatatgagcttcctgtaactgggctgaaactattgatacattcaggccagaagagtgggtctgagtatgcactgtttatttcctggtgggcgctgccttctcagcttggctctcatttcccattactgctttgctctgactcactgatggcctgccacatgtcattaggcggctcaactgctgctctcatttctcccaaaggtatatggaggtttgtgtcttggcttctacactttttttttttttttttttttccggagagctggaggaagtggccttttgatagttttgtttgttgagttgaatacttgtagtgtcttacggtttcaattttcctttctcatagatatttgatcctgatgacctttattcaggggtcaatttctccaaggtactgagtactcttttagctgtcaacaaagcaacagaaggtaagccgggcttgtgatttatatgttctgggtgacatttttgaatccatgtgtttgtgattaccctaggagccaactctggccaggattgttctcgtgatgcaaattttccccttgctcccccaaatacaccccaacaaatgtcaaatgcttgaatttttcatggcttaggatttaaaatatacctatcatagatgttattctaatgcccttaatataatgataagaactaagaaactattccattcaaagctctgaatcaccaactgagtataacaaaacagagaagaaaaaggaaagaccagttccctttttcatagagtttacaaaatacagccgtcacttccctttccccactagagacatatttttctcattgttttatgtatgcctttgtccatgtaaaggaacccctcagtagccttgcaccaaaaatgaaatcttggggtcatagggagtgaaaataatatcttttatttaaatgtttaacacctaccacactagaggtattaaatataaatgctagtaaatgtgaagaaaatgatgatacacttagaatgtagcttcactccttccctggtatattttaccaacagctgaatagtaataatcatacttaaaatgctttgagctcttgccctggatctaggctgtcataagagccacaggtgatctcatccaatccttgaaacaacactgggggtaggtattattattattaggtccatattacagataaggaaagtcaggccaacagttgcccaactagaaagttagtcgctgagttgggattcagacccacatctgaatgactacagagcccttatgcccaagcacgaggcttgctgctcaaactgttgtagagtcaagaggctgtgtgcccagcatcgccaggtgctacaaaaaatgtcaaagctatggtccctgcctttgagaaaattactgtctatttaaggagactcaacttacccacgtgaaacaattagaggacaagagcagacaatataatcaagtgccaaataggttagagcatctaggaagctatcgagtaattatagtttttgtcaaaagagctgtatataatagcaatacaagtaaaaatacttctccaaagttgttcttttgctatttggaaaaaaaaatgcttttgagctattgcaaggcgtatagctgaaagtacagctaattcaagtaactatatttaacacacatgacaactatccagttctagtcagggaggatcgtgtaattctaacattatgccacacaaattatacgttcctttgccaaactctcctagcaagttttacagtctcttcccttgccacagatatttataaaatacaaggaggtgaaagttaaaacccacagcatcaaggaaattacttggatactgagcttgtcgcctagggaatgtttgggctttagacttttgcagtttatatcttttaaaaataaatggagaggaaaagaacccttattgaaatttgtcaagaagccagctcctctcttttgtatactctcaacaaactgaaaacatccagctcagctctggcctggtcgaatttcacaaggtttcaaggaagagaagactcttgaatctgattgttaaaaaaattattctagtatcaagattacatctttcccaaacacatcttctctttcactctcattctccaccctgccccacacacatcagggagattttacatcatatatgccacacatattgttacgtgtgagtaagaaatgagccactgagttatgggccaaaaaacaaagagagaaatttgaaatatttcaaagtaataagagccacaaacagctgtttggtacccaatatagttctgccttggataacagggcatactgttgcaactggttcaggagggaagagttgtagggaaatggttaagagaaaatgtggttctgtcgctgtttttcattctactggagcacgatggccagtaaggttaagaacaggaagttggccaccaaaaagggaagggggattgaaatacacttggcatgttcataatgataacagttagaattacagccaggatgcctctgatagtatcctgagaaagataatgttatgcggtagatgtttttctgatctgagtggttcctttaacatgccttttcctcttttcacagatcagctatcagaaagaccatgtggacgttcctcttctcttagtgctgctaatacttctcagacaaacccacagggagcagtttctagcacagtttcagggctgcaaaggcagtcaaagacagtggtaagtatagtccccaattctccgtctgttttaaaatccataaaattagattgatatcctagttgcatctccatatgtggtgagacagccatccgggttgttttgggcatcactgagaaaactaattataaaccgagcaccaattcaggctggcccgaaggagcaaatcaaaggcatgtggtggggcaaaaatccggattgaagctccagctctgtcccttacgagaattaggcaagtcacttaactgagaatgctatgcaaatggaagtcattatggctactttctgatggcagtttgctgttaatttccctatcccttgttttattagaactaaatagtgcctgacacatagtaggcaatcaataaatattgattagtatcctcattattattgccatttttatttttctctttccattcctaatgaggaaggcttgattttaaatttcagtctatgatgagcttctatattaggatctcccagttgccttttcacttgctcttattgggagcttttatttgggaggaaatgcctcatcttctgctctttgggtgaaacctttatttcctgtcaaaagccacccacttgcagtaagacattatgacctattacttccaaagcacttgagcatgtggttcttaacttttttggatcacagatccctttgaaaggctgatgaacactatgtctctacacccctggtaccctctcaaattgtatacaaaagcccatgtgtatgaacttatttagacaaaaatatgttgtgctcatcagattctctaaagggtctgtgaccctcaaaaaggaagtccagtttatacatgacagattaagaattcctgacttaatatatccatgtaataaaactgcagttgtaccccctaaatctataaaaataaaaaaatggaaaaaagaattcctgacttaggcaactatgggttatttgatctttgcatataaataagtcttagccaaattaagatatccttagtaattaggagatgggaggcagattttatggagggtaggttagtacatcttggttatataattatgtggactgtttgtgtgttgagtagaggcagggtggaatagcttatccagggtggaatagcttatcactctactttgttatctggcttagttaaatagataatctttagataatggggaggggtgtggagagaaaaatgaaagctatgacccacttcaaaatacagattctcacaaatgccaaagtttacatactgttttgagggatttattaatccctctgagacccattcatggattcctaagttaaaaactcaggactgagatggatctggggttttgtctttgcttcctccactttatttgcctatatccatatcatttctacccctgccttatttagatgagtgcttaatctggtgtggcttttgtttctctaggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtggtaagtgaagtttttaaaaggctttttgattgtgactcttgtactttcttggtattcttactgaaaattgtgtagttttaattggttaacagaagctgtttatacttgtatgtgtatgccaaaaataagagtagaacagaactgggaaaaatctgtgattagatattttgaaacaaattgtatttagattacattaaggcagcagaaaaataaaaaaagcaaaggaattcaaagctcagacaactggtccaccctaactgtatccctttatgtctactaattctagcccatgtaatatagtacatagtccttctcaccactctaaaacttaccatggcagaatccaataataagagaggccatgtgctaacttcctttttttagccttaagccctgtaagcagacctgagactaaatgcctcagacatgagagataataatgatagggctgcaggaagctgtctggccgctttgatgctgaacaagattgcccttaactcactgaatactgctagctgtttaccttttttttgtaacaatagccagagaatgaaatcgaattgctcttcagtagtcttttcttctctctctctctttttttaattattatttttagacagggtctcactctgttgcccaggcagagtgcagtggctatcacaactcactgcagcctggacctcccgggctcaagtgatcttcttgcctcagcctcccaagtatttgggactacaggtgcacgccttccacacccagctaatgtttaaactttttgtagagacggatctgcctgtgttgcccaggctggtcttgaactcctgggctcaagtgatcttcctgtgtcggcctcccacggtgctgggattacaggcataagccactgtgcctggccactcttcagtagttttccttagagtttttttgataattcacttgccctttattgtttaagaaggtaggctcttctgatattgcaaaaaacccagcaaacccttatacataagaatatgtccctcacaatacacataaaacagcatttagttattcacattattacatctctttacttttcaaaaatatttacacaagggctcttttgagtggttagctcagcgcattatttcttttgtaaatatcttattgctttttcaatgcctcaaaattgatactattaattaattaataaaattttaggctcactgtaagtaaaatgaaacattctggaaatatacggttgactctatttttttttgttgttgttgttttgagacggagtcttgctctgtcacccaggctggagtgcagtggcgcaatctcggcttgctgcacactccgcctcccgggttcacgccattctcctgcctcagcctccccagcagctgggactacaggcgcctgccaccacgcctggctaaattttgtatttttagtagagatggggtttcaccgtgttagccaggatggtcttgatctcctgaccttgtgatccgcccgcctcagcctcccaaagtgctgggattacaggcgtgagccactgcgcctggctacagttgactcttgaacaacatggggattaagggcaccgagcccccatgcagttgaaaatccgtatataactctgagctcttgagagctgaaaatttctgattcattttgatattcttgaaggctggcacctgagtggcatctcattaagggctcaattcattcaatatggagcaggtactggatgagacactaagaatatcaagaagcattccatcaatttcatcaagagggaaatatgtgaatatttggaggcagctgtctttctccagagtaacttggtaggatttcccacactttccttgccttctctagaatgatttcaatacataaatttccttcttcaaacatgtggaacttgaagacccttaaaggcagtaggatcattagggcttattagttacttctagattctagtgttcagagcattgctttattttcatcactgccctaaagttacgactttaagactgagaataaataaaacacacacacacacacaaaaaaaaaaaaagaaaagaaaatccatgtataacttttgactcctccaaaacttaacttctaatagcctactgttggttggaagccttactgattgtatgttatatgtattgtatactgtgttcttataataaagtaagctagggaaaagaaaatgttattaagaaaatcataaagaagagaaaatacatttactcttagttaagtggaagtagatcatcataaaggtcttcattttcattgtcttcacgtataaatgggatgggcctgcaaagttcaaacccatgttgttcaagggtcagctgtataatgtagataatgaaagttcctcttctctttgcactctccccccgacaaccagagttaggagctttttcctaaagtgtttaagataaaattaattttcacacttttctgtgttctatgttgtgttaaaaggggtatcccctttaatggaatatgtttactaacagatttataattatatacgtatatggagacttcttagcatttttaattactgggaatcaagaaggttctattgagccctggagtatttccacaggctttgcctggaatttccttggttttgatgatattcacagacgatttttacctctcactacatctttcaatcgatataattttgttgatataatttaggaaaatccctaaaagattttccaggttcactctaacattgttccctgatacagtgtctttatctgcaaaactaaaaggagcagtaattttgtccaggaatcccaagcactgcgaggggacctgggaagtgaacagcacaccctcactttgacgactctccttataatgtccctcactgtgactccttgtagcagtctggccactcccttatagactgccccaggttatttgttctggtcttaggggccttcattttaaaatttctcctatattctctctggtttaggactcagcttaggattcatgtggcaagctccgactctgacttgagcacttaggtaacccttagaagcatctaacccaactgtcaaggacaggtctgagttgcttgggtcaggaaatgagtgctagtcagggaaggcctggaactagcagtgtatggaacaacctctctcatttagcttatggcagcagcttcctaattggcatctctgcccctgtttttgtcactcctataatccagtctaaactcagtacccagagtgattctttcaaaatgtaacttggggccgggcacggtggctcatgtctgtaatcccaacactttgggaggctgaggcgggcggatcacttgaggttaggaattcgcgatcagcctgggcaacatggagaaacaccatctctactaaaaatacaaaaattagctgggcatggtggcgcatgcctatagtcctagctacttgggaggctaaggcaggagaatagtttgaatcgaggaggcggaggttgcagtgagctgagatcgtgccactgcactccagcctgggtgacagagtgagactctgtctaaaaataataataataataataatgtaacttgggtcatggctccccatctcaataaaagaaaaggccaaggccatcacaatagcctccaaggtcctccaggatctggccttccgttgcccttttggcttcctctctgatctctcttcccctcactcattccactttagccacactggtctcttggctgcctgtgccagacaggctcctgcctcacttgctgtccccctgtctggaacattctccagctatcagcacagctggctccctcatctccttcaggtccactcacttgcctacttcacaggagggcctttcctggtcacccaggagaaaatttaaccctatccccactccctctatccctcttccctgcttaaattttttgcttattatttttccccgtctaacataatacacgtttacttatttatttcatttactgtttacattttaccattagaattgtaaataccacaagggcagagacttcattcgttttgtttatgctcagtaaatatttgtaaaatgaatgaatattacagcgtaggtaattcaattctgttcagcttgttcactgagtacctcctaggcgcaatctatacctcatagaccccgtcccctagcacctttacagtctagtaatcaacacaggtctgtgcagaactaactgttacaggccaggacacagtaagtagcacagacaaaggactgagtaagatgctgtaggaacagtgaagaaacaatttgattaacaataacataaggagtggggaagcacttgaattgggtcttgaaggatagaagaagcttctgactgggagaagaagatcagagggaacttttaagttcaagcatggaagtaagagtggatggtggggtgatttgggttgagaatcagatgcatgatgataaggaatgggaccttgagctggagctacattaagaggcggtgtcaatgtcaagttttaagcaagggataacatggtctaggaagatctttctggaggtagcgtgggggatggatttcagggaagtggtaggaataaccagcaagggtgtagagaaactagcagaggctactgctaaggtccaggcaatccagatagtggtgtggattactctggggatagtggggaggaagagaagtggatggatgcagtatatactattgaaatgaaattttaaaaacttgctgatgattagttttgaggataagggaacagatgagaacaataccaagtctagaggtccagcttgatggtgaacgccttaatggcatgcagtgtcatgcttctagccagcccacaaaggttgatctctcttaatgagggtgtcagtctctgtcttggacactggtgtggtggagaagcataagacatggcttttgccttcagggtgttcatactgtagtgtaagaagacatcattagaatacaatatgataagtttagtgatagagctaaatacagtatgctatggagaggtgggaggagaagagaggagcataactcatcttgacagggaagtcaaggggacttgttcatctttgtatactgtcttgtcttcatatgcctaacatggtgctttagacattggaaatatttgaagtgtgctgaactccgttaatagagaagacaggaggaggcagaggttgtgtgtgcatgtctctgtgtgtgtctgtgttgggcgggtgattggtactgaagatgatgaactgttttgtacttgagtagaggtgcaccgagtcataggtctgaagatttctagcaagtagttggcagtatggttatggagcacaggagagagataagagctggtggtgagtcaactgacagtataggtcagtggacgatgaagtataaaatatatagcagagcatcagtattcagacacagagagtgcattgtgcctgaagaggttaggggaggcttcatggaggacatagggcttaagctgaacactgaaagacaggtaagctgtgaataggcccagaagagaggcaaggacaatctaaatcacagtgattgttcagggaaaacaaaacccaccacgattctgtggtaggactgaacagagtgagcttgatggacaatggaagagactagcttcaggtaacaaaaatgtcttgctgggaaattaggtgctcaataaatctgtgttgacttgaattctttcctaccccaactcttgccaccaccacaaaatagtaggtaagccaaaacctatctaggatgctgccgaggaatattttaaattaaatgctatgttgtgttatgtttggtctagaaaatacttgtaaatttttaattaattaatctctctctgtctttttttttttttaacacgggatctcactatgttgcccaggctggtctcaaactcctgggctccagcgatcctcctgccctggccttccaaagtgctgggattacagaggtgagccaccgtgcccgggctttatttctttgaatgaactccatactaatgtataagcttaggaaaatttgtctttaaggagtttgaaaaaagtgatgtagtgaaaccctttttttttttttttgagatggagtttcgctcttgttgcccgggctggagtgcaatggcgcgatctcagctcaccacaacctctgcctcccaggttcaagtgagtctcttgcctcagtctcccgagtagttgggattacaggcatgcgccaccacgcctggctaattttgtatttttagtaaagaatgttgatcaggctggtctcaaactcccgacctcaggtgatccacccgcctcggcctccaaaagtgctgggattacaggcgtgagccattgtgcccagccaacgtagagttttaaaccccattgccatacaaccttttaggccatttataaagttcaatcaggcatggaactaaaaatctttagtgatctcagtctgcttactattgggtcaaacatataacactgtggccactcgaagagtcagtaattctgacacattcatacatgcagcctggagggtggagggacatttagcctgatactacacattcttttgtaatgtcttacaagcagaacaaaacaagcccaaagccatacaaccctcaccctgcagattgctgtgccatgggagtgctgtgcgtagttttcctcccttgagcctgtcattgacaagagcactttgtgctctggtaaatttgcccttggggagtggcgttttaagttttggattccactgtagctctcatctagagataattacggccaaagctctggggatagctttttcccgctctttgagaggaggccgatttcagaggtcgtatagcataaagaatcacccacctaatactatagaaagttaagaaatagaagacgtgagtgtgaaacacacacacacacacacacacacacacacacctctttttaacatgagcttgtggctgaaagtagaataagtttttgtgaccatgatgataaaaacctctttccaaggatgattgaacctggacattgatgacatcatgaagccattgtcaccaattctgcttgcctacctctggatttcctattacatgagaaaaaccctattttgaccaaaaatatgttttttaaggatcttatttcatgaaaaatacatgtattaataacttagtcattatataagttacataacatatattaagggactttgctcttgtatttcatttgagtcacatacattataaatgagaaaattagccacttatacaattttccgttctctttgaaaaatcagtggtaacttgtaaattaacttgttatttatacatcaaagtaatttctgctagcacagtggcaacataatggtaattatatcctttttaaatttttgtctctgttttgttacctagaaaggttgagggttttgttgggactttgcattaaaaatttcctggcaaaatttttaagccaagaaattattgatgcaagtgtgattgagcagatattttaaacaaattctattttctcccactgattcaattaagagggcatcaaatccttcttctaaaacttcttattagcagtaaatatagatatcaattgaggggattaggtacatggttaattaaatttgtattaaggcatattaagaaatcactcttcctgctcattataaccaaagctaggattgagctttatatttagacttcctgttttaatcccctgggtgtatcacatagatgtttcctgtccagagagactatttgtcactagatttctttttgtcttatcaccaccaacaggcaatagtaatctgtacaccagcaaaggaagagaaagaatcaaaagttaattggaaaggagtctttacatcaggatcaggaggatttcttatgcctgtatttgtgtgacactcttgtttgagttatattatacgaacaatccattggaattcttcactatattgactgatttccccccgcactggttggattgcccagtctcctcattgccttagaacaccacctaaaatgtttacattttcatgttcgttctagttagggcactttgaatcccccccaccacccagggactgaacttgtctcctcggaacctccacatattcattccttctctgcatgttgctgagtgtgggtttcaaagaatccttcacatggcgggagtaagaagtggtaggggtcggggtggggagcaaaggagggacaagaggccagaaattgtcactgaggtcatagtgctggtgtttttctctttgcattccctcttgtactgtttcatggagccagtcatttgcaagggctacatttttttagactttccaagtttatccttccaaatctgtctcccttctgttctttgtgttaattccccatcctagaccaagactgcagagagaactagaacttcagtgctatgctgaattaatagtggtgagagcatgcatccttgccttgttcctgatcttagggggaaagcatttagcattcagtctttccccattatgtaagatgctaactgtaggttttttgtagatgcactttattaagttgaagaaattcttctttattcttatttttttccatgagttattttttttcgaataggtgtttaattttgttaagtgctttttctgcatcggttaatattatcatgtgacttttttcttttaagagtgttaagatcatgggttacattaatggattttaaaatatttaaccaacctaggatgaatcccatagtatacaattcttttaaaatattgctgaattttacttgctaatattttgtaaatttttttgcatctatattcatgagggatattggtctgcagttttcttttttgcactgcctttgtatggttttggtgtcagtgtaatagtggtttcataaaatgacttgggaagtgatgttttttattttctatgtgacattatatggaattagtattgattcttccttaaacagttaatagaattctccagtgacaccttatgggcctggagatttcctttttcagagttttaaatttataagttcaatttccttaatagttataaggccattcaaatgatctatttcatattgggtgagttgtggtagtttttgttttctgaggaattggttcatttcacacataagtgtcaaatttatgtgtgtagagttgtttgtagtattccattattatcctttttatatctccagggtctggagtgatgtcccctgtttcatttctgatagtggtcacattttcccaggaaagccttatgaaccaccagtggatccaggcggatcctgaactagcataaagcttccaggaactggctatgctccacttgtcctctctggagagtgacagaattgtccctcattgctacttttctgccttattttcactctacccaacctggccccactggataactcactgtcgcaagaacagttctgccttgagcattgccatttctacatctgtgtttctgaaatcttccctgaaaagaaaactctgtactgccttccctgcctgtttgaattccatctgcccttcagggccagatcgagtacctccttcccagcaaggtcttctctaaccatcccagatcaaactcacagcccctctgaactccagcaggaacccctgcccatgccattgaccaagaccttcagtagctttatctctgggtatcatattggttaggaacacaggctcttgtcaggacatacctgggcttcaatcttggctctgccatttcctagctgcatgacctgagataactgacttcacttccttgaatcttagtggcctcctccgtaaaatgagaagatagtctgcctgtcagcgttgttgtaaatatcaaataatatgtcttaaaagctattaagtatgaaataaatattagggatattccaatacaataataattaaaaatcaaggttaaatgggaaaatatttataaaataatattgtaatagaagaattataaaactgcaggtaaggttagaaagatccaagagtgtgtgcatatgtgtgttcacaaacatacataaaagaatgggaagacacacttcaaaaacagtctaaatgatgatggttagctctaggtgattggctaattgctgggttttattttctattctatattttaaatttttgggggtgggactgcaatagatttataacttgaaaatattattaaaaaaatcaaggtctgatgatatagtattatttggttatttatactgcgctatactttagaaagggtttaaaacagcataaaatatagcaagttaaaattaaaatataaaccaaagtgaagcagaggagaaaatgcagtaggaaagatgctatgttgtgacactgctaaaaatttgttatgactgtctcatatttttattgttttttttttaaaaaaaaagaaagaatgtcctaggatttcctttagtcatgagtttaataagtaaaattaatttaggtaaaagaagggcagtattttacaacgcagtggaataatattaaaattatacttaaaagagaataatttcctgctagttttcattgagttaaaccttctgatcattttgttgttggcatagtagacagacccaagaaaagtatgcttgccattacttatattttattatacttgtatagtaaattgcacattataagtacagatgcttcttggcttacaatggggttacatactgataaacccatcataagttgaaagtatcataaatcaagaatacattaatacacctaacctactgaacatcatagcttagcctagcctaccttaaatgtgctcagaaaacttacagtagcctacagttgggcaaaattatctaacacaaagcctattttataataaagtatttattaggtcatgtacacagtagtttgccaaggcaggaaaatatcaaaataaagtatgatttctactgaatgtgtatcgctattgcaccattgttaagttgaaaaatcgtaagttgaaccatcataagttggtgactatctgtatacatttggctagtattggttttgcgtatctgttttgaataagttgaatggagagggcagacaaaccccaactgggagtaaagttcttgccctggccctgctatttcttagttaggtcttaactccttggcttattccttctttggaaattgaggggtctagacaagaagatctaactttgaccatctatagtttagcacagttgtagtttcatttgtttaggaatgtacatttccattgatccttccactgggaatctttatagtatgttagttgacccatgttataaaatgttcatcatagccttctgtgatattaacataatttaaatgtttttttcacagagagacctctctccccaaaagccgtcaaaggatttgaaactgctccacttaccaagaattattatactgtggtaagtgttcagatgatgaataaaaattttcttgactctatatggaactttttcacttgtcaaaccattgatgtgttgaggtgacacaaaggaaagactgaataaagttgcatgcatgagtctaatgccattcgcattacagtggagctcttttacttatatgcttcttgcagatgtctagaagtcttacatctactgtgctgaaaaattcaaaggtagcacggattcacagcaagccctattaaacagcatgaaatagaaattggctagtatgtaagaattatggtgaaattcagcagttagacatacccttaccagatatttagaaggtgaatttccaagttcctgtaatgcaataaattttaagtggttgcattttgtaattttactttagaatcaatgacttcattattatatcgtctggaatattatcatcctttaaagagagcccaaaaggaaaactgccctttggcacagtgggaggaatgacatggctctggcttaaacacagatatgtcaaaatatgttagctataaatagggtatgtgcaatactcaaaataaattcctgtttgaaaaagaaatcgcatcattctccttcatctactctctgctttctcttcatgtctcctttccagacttggcctagtcactaatttaaaggtcaagtcatgattaacctctaagtttccctgtctggtagccttgtcattcccccggccctgcctcaccacctcagctgaaatacagtttcactttttacccagtgttctatgtgcgtttgtcttgcgtactcatctccctttgtgcatggatagagtttttaaacatctctatacaggtatgtgaatatcatttggtttcaaaaagttgaatttcactcttcagtgaatttgctctataatgatgacatgagcaatagagaatatgaaaaatcaagaaggaactctctaggtaacatggacaataaataatcacagtcgactattttgttaatatcttttatcttacatttccaaggctaaaatatattacccagcagaggtaggttcccttctcccttacttcctgaccaattcttttagcttttagataacccctaatgatttaatttttaaagaaaggttgtagtggaatggtggatgaaaatattaccatagctgcttctctctgtgggtctggagcatatcatcactctgctttggatctctctctgcctctgctgattctaccaacttaaagtgtggttgggattatccaaggcagagtatactctgtgattctcatggaatttatatcaatcctatatatataatggtcgaactctggacatgctgcagtttatataacccacctcctgttggaagacgtgtgttgtttctagttccttgctgtaatagacaattctgcattgaatagcttatatatatcactttgccaaagtatataaagatctgtatggtgaaagttaagtgcttaggtcaaaggacatatatgtttaacagtttttttttggtagatatcatcccaaacctcagacctaataaagaaaacaaatgtcttgcggaactcatgatagcctgtgaagaacctgtagaacttcgatgtgaatattgcttaattattggccagctggatatattgtaactagatatggatgtgaagagattttggttggttggtttttttaaatccacatttctctggctttgaatagttaggcaaatttttagtgtcaattaattcaaaatatgttttgagtgttctgattgtcctcctaatctgtgttgaataaaaaaaatctatttcatccacaggatttgtagacttgtaaaatcaatttcactcacatgaaaagtgccctcatctgatggtatattaaatcttcttccctccaagagtcattaattgtagatattttgtgttgctagatctataagaatactaatgactgatttttacttcattaaaaaaatgaaataacatttttcttttatataactagttatataaatgtttttaaaatatcagacaatacagaaataatgtaaaaaagaaaataaacaccacatgtaatcccaccacttagaaataatcactattaacatgttagtgaatttcatgccaaattttctttaaggtaggtgtaagtgtatatatatatatgcatatatatgtatatatagcctgtaatatctatgtgtgtatataaatttttaaataaaacaggaaattatgtattctttctttttcataaagatttttttttttttgacatggagtctcactctgtcgccctggctggagtgcagtggcacgatctcagctcactgcaacctccgcctcccgggttcaagaaattcttctgcctcagcctcccgagtagctgggactacaggcgagcgccaccacgcccagctaatttttgtatttttagtagaggcagggtttcactatattggccaggctggtctcgaactcctgagttcgttatctgcccgccttggcctccgaaagtgctgggattacaggtgtgagccactgtgcctggcccataaagattttctatccctataccccaataatacttgtctctgaccagacctgttctttttttttttttttttttttttttgagatggagtctcactctgttgcccaggctggagtgcagtggcatgatcttggctcactgcaacctctgcctcccaggttcaagcgattctcctgcctcatcttcccgagtagctgggattacaggcatgcaccacaattcccggctaatttttgtatttttagtagagacggggtttcaccatgttggccaggctggtctcgaactcctgacctcaggtggttctcccgctttggcttcccaaagcgctgggattacaggtgtgagacactgctcccagccagacctgttcttatgctcttccatttaatgagtctttgccagcccagggctccctttattttggtcctgtgtattagtcaggtttcccagagaaacagaaccaatgtggggggtggggggcggtgggggaggagagagagagagagagagagagagagagagagagagagagagagagagagagaatgaataaggaattggcacatgtgactatggaggctgagaaattccacactctactgtctcaaagctggagacccaggaaagctggtggtgtaattccgtacaagtccaaaggcctgggaaccagagagctgatagtgtaagtttcactctgaggtcaggagaagatcaattttctagctcaaatacgcagacagagaaagcaaattctcccttcttctacctttttgttctattcaggtccttagcagattggatgaagcccactcacaataggcaggcaatatgctctactccacctactaatttaaatgctaatctcatctggaaaacccttacagacacatgcagaaataatgtttagctaaatatctgggcaccctgtctatcctgcccaagcttacaggatgtgatgattaattttatgtgccaacttgggtcgacacataaaattaatcatcacatcctgtaaacttgggcaggatagagacctctgggaatttgtaaatctgtagacatattctcccctttttcaagtttctaagggattatctgctgatttcagccccatttaggccttgatgcaattctggtgtcatgtcaattttgaaatgttacatagttgtccagtgtgaccaaagtggctgtgggcacccagctcagacccgcacctgccactaggcatgtttaatgtgggtaactgagacttggccactcctggcttgttgttttgaataggaacttagcatccttgagggacatggcagtccagagaaagcttttgctgcccctgaccttggttccttaattgtcctcaattattgctgccatatgttaaacttctctcactattaattatttttctaataatcttcttctgcccattgtctttctttgctcattgtaacttaatgttatatgccaggaagatttaaaaagtaaaagtcagaaaaaggaattgatacagcttggttgtcaggctttatttgtgtgcagcacttaggtcttggcacccatggtctcattgggagggcaggtcaaacatgatagtgtaagccacatggtagagaatgatgtaaggttgtaaggtgttgtaaggtgggtttttcaaaatgcggttgggatcctttgtctcggaggcacctggggagcttgttaaaactacagacatacgggtgtggtggctcacgcctgtaatcccagcaccttcggaggccaaggtgggtggatcacttgaggtcaggagttcgagaccagcctggccaacatggcgataccccgtctctactaaaaatacaaaaattagctgggcatggtggcctaggcctgtaatcccagctacttgggagacagaggcaggagaattgcttgaacctgggaggcggaggttgcagtgagccgagattgcaccattgcactccagcctgggtgacaaagtgagactctgtctcaaaaaagaaagaaagaaagagagagagagagggagggagggagggaggaagagagagagaaggagagaaggaaagaaagagagaaagaaagaaggaaagaaagaatgaaagaaagaaagaaggaaagaaagaaagaaagagagagagagagagagaaagaaagaaagaaagaaagaaagaaagaaagaaagaaagaaagaaagaaagaaagaaagaaagaaagaaaaagaaagaaagaaagaaagactacagacatctgggccacacacctgacttgctacatcaaattctctggctgttgattccaggaaatagcattttaaacaactcccactccttccttaaccacttccccttaacacacaggtggctctgatgctcacttcacctaaaatatgagaaccaatcaaggaaaaggttgaatggaggatgtaggattcaaggcaaatcttggaggaaggtcggaagttagacaagcagagaagagctgaaagcttattcagacagggggagccatatgagcaaattctcccaggcaagaatgtgcctgtctgtaattagtccctgcaggtcagagagtggactgcacgctcttcttctcccatccaaatatcccttgtaagatgaaattctttattcactgcaactattgcaacacacttaataaagctggcctttgtgctgtcacaaataggccagactcacagtaatcctaatattcaactctggggatgagcatctgtgtgcagagtgaaaggtggtatttccccccatccaagtaggaaaatataatcactaaggaccaatatcatttattttgttcttgctttctcctactttatgtaacataatggtagatgcctaaagggcatgttttatagaacctgcctgcagtagaaaatgtgggaggaaggctgtggcatgttacattacaaaaatcctaggaagcctcgggtaacctttgctgtagcttcccgccttctgctcaccctcattttctctctcactcatctatctacctctctctgccaccctggatttttctacctttctagtgctcacccacctttttaattctactagcctaaactaccttacacatctatccattgattctcttttccatatccgctcttatttctttcttaccctcttcccatcttactcctccatactgctcttccatgtgagggctggaggtggaggaagtgacaggatcctgtggagttcgtgaatctatttgtggataatggggagtagtgctgcttgttttgtgaaagctaaggacctgggcgtgcagaatcaatcactgcaggcggttctactggcatagaaatcaaatatgacataaatattataatatattgccctttttgttctcaaagaactttaccaacattagctcattttcataggcaccataattatctcagaattcctataatgtaatatttttgctttgatttaaggtttcctgagaccattatagtctcctttatcattggagatatctctgttttcagccattgtttatgcattttagtttcttaaaataatttctttatacttttatgactccttccctttggaaaacatagttatacaaactcactctaaagcctctccaggaaatgtgggaaatgtgttttattggaaaatcaatagcccaggatggtggtagcaaaagcctccacctttttttttcctgtggtttctcactgtctattttattctgaattcaggcaaaggttggttgagcaaaaggatgcccagttgtccttgtgaagacagagtcagggaggcaaaggcagtgtctggacagagtctattttagtgagtttgaatggatttcatcagatcaaattgtactgctctgaagttgcttggcctggcaaactccttgccttctgagtcaccactgaggccttctgtttgggagcacatagccttctctgtctgcttcccttcttatccttttacattagatgccctgtggcctgaaaaataaagaaccagtctcagaagttcatcagttgatcttttgagattgaagaaagcaataaagttctgagtgactttgggaaggaatcccaaacatccaccctgatgaacattcctgctcatccaaccacagcaagagaagttctatttagtatattactactcacgtttttttttggggggggggcataatttgataaaaagacttattaaccacttttgtcattttaattttgtaaagtccattctgccactctcaaaacttgcagtcataggagtttaatgtatatttccatttagctctccagaactcactccaaggcagcaggaagtgtctgcgtgcctccctcccatgggaagtaactgccctatgccagtggttccagcagagatgggtaccctagaaagtgtgttgcctcacctagcaaataaacccactggagcaggacacttggcatctttcttgaagaatcttagcaatttcaggtacaagagccccagatggtagcattttaaagggagttgaaatattaaggctatttcaatgggggagaagcagagtgaattatatcaaccacggaattaaagtagtgtttgttttaaaaatcacattttatgatgaaaataatatctatgatttttctaatttaaaaattcccttcaagcaatgactgtttgctgttgtttttctttatttcaacagatactataattcagggactatgacagttatagacaacagtgctttaagggagggtgacagctgggcatggttgctcatgcctgtaatcccagaactttgggaggcagaggcaggaggatagtttgagcccaggaattcaagaccggcctgggcaacatagtgagactctgtctcaacaaaaaataaaaaattagctgggcatggtggcatgtgcttgcaggccgagctacttgggaggctgaggcaggaggatcatttgagtctgggaggccaatgctgcagtgagccaagatagcaccactgcactcctccttgggtgacacagcaaaaccctgtctcaaaaacaatcaaacaaacacacaacaaaaaataaatgaataattaaaaaaatttaaaaaatgttagaaaggaagggtgaggatgtgagatggcttgttaccagacatggtctttttagaaaagtgtgaacaggccaggcatggtggctcacacctctaattctagcactttgggaggccgagatgggtggatcacgaggtcaggagttcgagaccagcctggccaatatggtgaaaccccgcttctactaaaaatacaaaaattagctgtgcatggtagcatgcacctgtagtcccagctactcaggaggctgaggcagaagaatcactggaacccaggaggcagaggttgcattgagccgagattgtgccactgcactccagtttgggcgacagagtgagactccgtctaaaaaacaaaaaaaaaaaaagaaagaaaaaaagagaaaagagaagtgtgaacaaaaagattagaagatttaattccctcccgaatataaaagggccctatcctttttgaatctcaacaccaatactatagataaccaagtaaatattttatttttatttttatattttttgagacagaccctccctctgtcgcccagctgaagtgcagtggcgcgatttgatttgggctcactgcaacctccacctcccaggtaaaagcaatcttcctgcctcagccttccaagtagctgggattacaggcatgagccaccatgcccagctaatttttgtatttttagtagagatgggggtttcaccatgttggccaggctggtctcaaactcctggcctcgagtgatctgcctgcctcggcctcccaaagtgctgtaattataggcatgagccactccccctggcccaaataaatattttaaataaagcaatgtgcatatgagccttacctcctcctttttacttaataaaatatagtactgttgaattctagtgcatttctctccatttctatgaattaaaaaaaatgaatatcagtgctgagtataagtgattacttgaggaactgcagtgaacaacaacacagatggacaaagagctatcatgatgaacaagcttgagtattgagggccatgaccctgcataaggacttggagtcagagaaaaaacagaagagtttttattgacaggtgagaaatttgtgctttgtttttaaataatagctttactgaggtacaattcacatagcataaaattcaccattttaaagtgtgcaattcactgttattagtgtattcacagagttgcacaatgatcgccactatctcatctaatttcacaacattgttatcaccccaccaaaaaaccttctatccattagcagtcacttcccatttcccattccctccagcccttggcaaccactaatctactttctgtctgtatggattttgcctattctggaagttttacatacatggaattctataatgtgtgatattttgtgtttggtttctttcacttagcataatattttcaaggttcatccatgttgcagaatgtatcagtacttctttctttttatagctaagtaatattccattgtatggttagaccagcttttatttatctatttatcagttgatggactttgggttgctgccactttttggttattattacaaatgctgctgtgaacattcatgtgcaagtttttgtgtggacatatgttttcacttctttaggagcagaattgctgggtcacatggtaattctatgtttgactttctgaggaatggccaaactgtttatcacagtagcagtaccattttacattcttaccagcaattgtaagagtttcagtttctctacatcctcaccaacacttgttattgtctgcttttttttctttgtaatataaccaccctattgagtatcaagtagtatctaattgtagttttgattagcattttcctaatagttaatgatgttgggtatgcttattggccatttgtatatcttctttggagaaatttctattcaaattctttgccaactttaattgattatttttgttgttgagttgtaatagttctatatatattgtggatactagactcttatcagatatatgatttgcaaatatttcttccattctatgagttgtcttttcactttcttgataatgtcatttaacacacaaaagtttttaattttgatgaattccaatttacttatttttgttttgttttgctttttgtgtcacccaagaatccattgccaaattgaaagtcatgaagatttcctcctctgtttactttaagacttttgtagatttaactctgaaatccattttgagttagtttttgtatatggtatgaggtaggggtgtaaattctttcttttgcatgtgaatatccagttttctcagcaccatttgttgaaaaaaaagttctctccccactgaatggtctttttttttaattgacagataaaattatatgtattaattgtgtacaacatgatgttctgtcatgtttagtcattgtggaatgactaaagctagctaattaacacacatattacctcacagagttatcatttttatggtaagaacaattaacattcactctctaggcattttttaagagtacaatatattgttatttactatagtcacaatgttgcacaagagctctcttgaacttattcctcctaacagatgtttcatatcccttgatcaacatcatcccaaccagctcccccaacttccccagccccttgtaaccaccattctattatctagttctatgagatcaactttttaagattacacatatgatgagatcatgtggtatctttcttactatgcctgacttatttcacttaacataatgtcttctaggttcatccatgttgttgcaaatggcaggattttcatctttttaatgactgaatagtattccattgtgttttgttttgttttgagacagggtcttgctctgtcactcagactggagtgcagtggtgtgattctggctcactgcaacctctgccccctggactcaaacaatccttccacctcagcctcccaagtagctggggctacaggggtgcaccaccacacctggctaattttttagttttttgtagagacagggtctcaccatgttgccgaggctggtctcaaactcttgagctcaagcaatctgctctccccagcctcccaaagtgctgggattataggcatgagccaccatgcccagcctccattgtgtttttataccatattttctctgtccatgcatccgctgatttcatattttggctatcatgaataatgctgaaatgaacatgggagtgcagatatctcttcaacatactggttttatttttatttttggaatttgaatctgtcaatatccacaaaataacttactgagattttgattggaattatgttgaatctatagatcaagttggaaataactgacatcttgataatattgagtctttctacccatgaatataggatatctccccatttatttagttctttgatttcttttaccagagttttgtagttttatttgtatagatcttgtacatattttcttagatttatacctaagtatttcatttttagaggtgctaatctaaatattatttttttgtttcagattttgtttattgctgatataaaggaaaatgattgacatttgtgtattgactttgcatcttgcaaccatgttataatcactcattagctccagaaatttttttgatttattcagattttctacatatacaatcatgtcatctacaaataaagacggttttatttcttccttcccaatgtgtataccttttatttttttcttattgcattagctaggacattcaatatgatgttgaaaaggagtggtgtgagggaacactcttgttttgttcctaatcttagtaggaaagcatctggcttcttaccattaagtatgatgttagatgtcggggttttttgttagcttttttttccctttttttttcgtagctgttctttatcaagttgagaaactattcctagttttctgagaattaaaaaaaaatcatgaatggatgttgtatattgtcaaatgccttttctgcatctgttgatacgatcatgtgattttccttctctagcctgttgatgtgatagattacattagtgattttttggaatgttgaactagtcttgcatactttgttaaatcacacttggctgtgttgtagcattctttttatctattgctggattttatttgctaatattttgttgatgatttttgtaactatgttcattagagatattggtttgtagttttcttgtaatgtctttggtttgggtattgggataattctggcttcataaaatgagttaggaagtatgtattctctctgcttctgtgttttggaagagattgtaaagaattgatataatttcttccttaaatgtttagtagaatttaccagtgaacctatctgggcttaatgctttctgttttggaacgatgttaattaccaattcattttctttactagatgtaggcctattcagattatctatttcttctcttgtgagtgttggcagattgtatctttaaaaagctggtccatttaatctaggttatcaaatttgtaggcagagttattaataatattcctttaacattattttaatgtccatgggatcgctagtgatatcctgccatttcatttctgatactaacagtttgtatcttctctctttttttcaatgaagttcatcaattttgttgatcttttcaaagagccaccttttggttttaacttcctctactgattttctgttttcaatctcattgatttctgccctaatttttattatttcttttcttctgtgtgctttagatttagtttgctcttctttttgtagtttcctagggtggaagtttagattatttattttagatctttcttctttcctaatatatgcattcagtgctataaatttccctacaagcactgctttcactgcattccgcacattttaatgttcttctttcatttccatttagttcaaaatattttaaaatttctcttgaaatatctttttagaaaataaatgtattttgagatgtgttgtttaatctccaagtatttttctgttattgatttctagtttgattacattgtcgtctgagatcatagattgcatgatttctattcttttaaatttgctaaggtgggttttatggatcataatgtggtctgtcttgaggaatgtttcatgtaggcttgaggagaatatgtaatctgctgttgttggataaagtagtctatagatgccaactctatccagttgcttgatggtactattgagttctagtatgtccttactgattttctgcttgttggatctctccatttctgatagaggggtattgaagtctcaactacaataaatttatctatttctacttgaagttctagcagtttttgcctcactttttttttttttttttttttaccaagtattaaatcacaggaggaatttactccaagaatgccagtcaacatactggacaatgtctttaactatagtttacaacaatagtttacaactatgatggccttttatatagctacttctaatgtcagttctcactgaaatgcataatattaaaatataactcagccaaagaaaatgtttcttttgttcatttcttttgttcctttgttcatttcttggaatagcaattagcaagtaccaatgtgtgtaaaatgcctaaaaaatacacaatgccattgtcaaatatgtttgaaaaacacaatatcatattggccctgcttagagattcaaaatatatttatcatactaaaagttctaaaaagctatgcataaagaaatttgtataaattatttaacagtttttcataattgttattgtcattctttgggaagttagatatatcaatatactttcagatttatcaatatactttattcacctggtctttgaatgagaatgggttaaataagcaaatttattgtcatttgcactgacaaggaactagagtgttaatttttttttattattgattgaagggagaacgcttccactgcaattttgatggaagagttttcatttgattataaaagttgtgcctcatgtagtttgattctgtttttaggcacatacatattaaggactgttatgtcttgttggagaactgacctctttattattatgtaatgcctcttttattcctgataatttttcgtgctctaatgtttgctctgtctaaaattaacatagccactccagctttcttttgattagtatgaacatgatatctcctttttcatccctttacttttaatttataagtgtctttatatttaaattgaatttcttattaacagcatatggttgggtcttattttttgattcactctgaaaatgtctgtcttttcattggtacatttagaccactgacatttaaagtgattattgatataggtggattaatgcctaccatacttgttactgttttctatttgttgcccttttcgttgttcgctttttgtcttccacatttttttgctttttgttttaattgagcattttatatgattccatttctcttttttcacttatcagttatatttctttaagaaaaacatttttagtggttgctctatgccttgatagctagtcccagttcactttcatataatactatacaaagatacatactatattcgcaggtagtgcaagtaccttataataacatagtattcctaattattacctcccatcccttgtatgatcgctgtcactcattttacttacacataaatacacattagtatatacacacacataatcaaatacattgctgctattattattttgaataaactgttatctattaggtcaattaaaaataagaaaaaagtttttattttatctttacttatcccttctctaatattctttccttcttcatgtagattcagatttctgacctatattgtttttcttctctgtgaagaacttcttttaacatttcttgcaaggcaggtctaatggtgacagtttccctcagtttttgtttgtctgaaaaagtcttgatatgtctttcacttttgaaggataatttcacaagatacagaactcaaggttagtgggtttttctctcaacactttaaatatttcactcaactctcctcttgcttgcattgtttctgaggagaggtcagatgtaacttttatttgaacttctgtatagataaactgtttgtttcccatggcttctttcaatacttttttctttatttttgattttctggagtttgaatatcacatgattagaattttcttttgcatttatcctacttggtctctgagcttcctggatctgtgatttggtgtctgactaattttgagtaaattctcaaccactattgtttcaaatatttcttctattattttctctttcctctcctgatatttccacattacatgaatgttgcaccttttgtagttgtcccacagttctttcatattctcttctatttttacccccagtctttttcctctttgctttttggttgtagcagtttctattgacatattctcaagctcaaagattctttcctcagccatgcccagatcactattgagtccatcatgtgcaggcattcttcatttctgttacagtgtttttaatctctagcattgctttttgattctttcttagaatgtctgtttctctgcttataatatccatctattcttgcacgttgtctactttttctgttagagtccttagtatattaatcacagttacttaaaaacactggtctgataattctaacattcctgtgttacctgacttaagttctgatgcttgctttgtctcttcatactgtattttttgccttttaatatgccttgtaaattgttgttggaagcctgacatgatgtactgggtaaaggaactgtggtaaataatcctttagtaatgtggtggtaaggtgtagaaggaggggaaacattctatgtttccagattaggtctcagtttttaatgagcttgtgtccctggactgtgaacttcacccgtgcttcctagttctcccgcttaggtgggacaggatggctagaaagggctggagttgggttatcttccttcccccatgtggaaggctagagctggctggagttgcttattgaccttcccccataacagttagcatctgataaaaattcaataggttatgctcaggccgggcgcagtggctcacgcctgtaatcccagcactttgggaggccaaggcaggcggatcacctgaggtcaggagctcgaaaccagcttgaccaacatggtgaaacccccatctctactaaaaatacaaaattagctgggcgtgatggcgcatgcctgtaatcccagctactagggaggctgaggcaggagaatggcttgaacccaggaggtggaggttgtagtgagccgagattgtgccattgcactccagcttgggcaacaaaagcgaaactgcgtctcaaaaaacaaaaacagaaacaaacaaacaaagcaaacaaacaaacaaaaaataggttatgctctggtaaaatagtttctcctgagggcagaccttgttaagaagaatagagtgctctggcatattcaaaaaggcaactttttccctccctctgcctgaagcatgagggtattttcctctaatcttcactgagagaaactggagcttaaactcacaaaagtgtgagtgtgctgtcctaatattgggcccctggagttcctaactctcagacttgcctgtacagagcccccagaagtttgtcaattacagtgtaggtttttctgccctagtgctggttcctgtggaggcttctgcttgtggacttctgctctggtaatttgtgattctctttatctgcctgtttctccaatttttggagtagcagttttccctgtgacctctcttttctgacagatttaagagaaaacgatggtttatttcagtttgtttagctatttccttcctgttaggatggagtaatgacttctaagctccttacatgtcagactgaaaaatgaaagtcttttttttcttttttaaaataggcatttataagtatatagttttctttaagcactgtttaactgcaccccatgagtttttgtatgttgtgttttcattttcattcatctcaaagtagtttctaatttccattctcgcgcttggactttctatagaggggaatatttctattccattactgggttaatttccgagaacatcaatacctccagaaccctgcatttacacttttagagggtagtttctgaggaatagaggaactgaaagtagacatgagtggctgggtataggggttacaatttaagcccgagcttttgaagccatcctgtgttcttctaagccagtgattctcaactgggggcaatattgcctttcaggtgacatttggcaatgtcatggcaatgatatgggcattccatcacaacaaagacttatctggtttgaaaggttaataatgttgctattgagaaacccttttttaaccctttaaattggtaggtctgtttcccacttacccagcacctatctgtacagtgtgtcactacatcttcataatggtcccccaggtaggtgcaatatcataatctgagatgatgtaagcaaagttttaaactgaagcaacctctcagtcagcagcagagtcaggactaccaccctgcactccagtggtttcccagagaacccacggttaccaggatctccacttgttttgaccattccacctttcaaaagcagatcatcatgcattgtcttgtgagtatatggctggcatattggtaggctaatacacttctcctagttaaggacacttcactctgtcttgtaactctctgtttaatgtctctgcaaatacagtataaactccctgtgggcagcacggcagttggcagaataggcactcagtcgattttgttgaatgaattagaatatatgaaagaaaatataccagaatgttaactgggttgtccctaagagcttaaatgaaggtttttaaaattattattatactttaagttctagggtacatgtgcacaatgtgcaggctcgttccataggtatacatgtgccatgctggcccactgcacccatcaacccgtcatttacattaggtattaaatgaaggttttacctgtcactagaagaggcttggaaatgggttgtgacatgaccctagaactggtaggggaagagaaattgtgatcccccatattggttgttttgcctataggattctaattacattaataataataatgataatttttatttctcttgttaaattcctcacacttcagcctactttgttctttgaattgtttatggtagcaccttttgcctttaagaaaagactagttttaactctgcttaaaaattcactgtatcctcagattttgttccccaaaggtcttatcacaaacataacttaaacaaaaatctcttgtgatgtttgttatcacagtgatccttaaattatactgacattaagtctctatgtctaaggtagctggcctcaattttctcctccataaaagaggaataatgattctttgttaactaactgagaacttcctgaggataaaatcatttacagcacatgaaaacattttaaacagtactgtggggtttgatgtggtctcacatctgtaatcccagcactttggaaggctgaagcaagaggattgctccagaccaggagtttgagaccaccctgggcaacatagagagatcctgtctctacaagaaataaataaccaagcagtactgtgtaaatcgcaaggccccttcagttatgggcaactgaaaaattgtattcatatgaattgtgcaatataaccagttgtcatgcaataattaaagtagtttgctagattgaaagaaaatgcattcagattttgtgttccttgcttgcaatggtagcctgagtaaataggaccttttttcttcctagtaatttggttaaaagatcaaagctacattttgccttagactatcgtgatgattataatacattgacttttttttccataggtgttacagaacatcctggacactgaaaaagaatatgctaaagaacttcagtctcttcttgttacttacttaagacccctgcagtccaataacaagtaagatgtttattttaaatccctcactaagtaaagcaacataatgtcaacatatggaatcattattcttatgtcactgaataattgattttgccctttagaagaatttccacagatcacaggttgccaagaacatggtcagggcaacagaaattatgcaagatattgcttttggagagcttggctttctttctcttctggctgtgaaaggaatgagcagatctgtgtttcttcctgtcacaatttttatcttgtacattaaaaaaaaaaaaagtgatgtgcttggttttaccttacaggaaaagaagtccctggtgcttttattcagaaagcacataaactggaaattctcatgctcactctgacctttgtttgccagggcagaacttctttcccatgctctgagaatggaaagagtatggcattttgtgaatgcttgtaagagctattcaagccattatttcacccaggcaaatgtgaatgataaagagatgctaaagtgtttttaaagacaaaatgttcaaaccttactctggtcttagaaatctgaagtgattgtgtaaagcctgaattgaaagaattgaaagctttagttttcatgaaagaaaagtagtgaccattttttttttatccttgtaggcacagcatatttaacaaatagtggtgaactgcatttatttgtttttattttaattaattaaatttcactagagatcatgatcatatagaaaatttaccagtcagcccatataatgcagaaaaaacccctctctttttaccttggaaagagtttactattgctaaacagttgtctaaactatcagcttcaaacttaaataagttaatatatttgagaaatttggccgggtgtgatggctgaaaagcctgtaatcccagcactttgggaggctgaggcgggcagatcgcttgaggtcaggagtccaagaccagcctggccaacatggtgaaaccttgtttctactaaaaatacaaaagcaaattagccgggcgtggtagtgcaagcctgtaatcccaactacttgggaggctgaggcaggagaatcgcttgagcctgggaggcggaggctgcagtgagccaaaatcacatcactgcattccagcttgggagacagagcaagactccatgtgaaaacaaacaaacaaacaacaacaacaacaacaaaaccaagcaaacaaaagaaaaagaaaagaaaaaatattgtgagaaaaattctccccttttccaaattatacttgtttagttataatgcctttgttcttgctaaatttcccacttgtttattctcctggcactatggaaatctacttcagtatgaaaaaattttctattcctgtgttgtaagagtttaaacatgatcaacaacaaagtgttttttgggccaggtgcagtggctggctgggcacgttggctgacgcctgtaatcccagcactgtgggaggccgaggcgggtggatcacttgaggccaggagttcaagaccaatctgggcaacatggcgaaaccccatctctactaaaaatacaaattagctcggcttggtggtgcgcacctgtagtcccagctacttaagaggctgaggcaggagaatcgcttgaactcggtaggcggaggttgcagtgcgccaagttcatgccactgtactccagcctgggggacagagtgagactccatctcaaaaaaacaaaacaaaacaaaacaaaaaacaaagtattttttgttattatcatgtgaaatatgaagtgttctgtgaatcatatttcttagagctgaagtaaatctgtaaatcattgggtctagtatcctgggagaaatgactatctctattaaatagagaagaagctgaagtccagacaggtttactgccttgcccatcccacagccagtacatggccaggctggagccactgtgccccctgctgccaagtgaaacatgctttctgttttctggaagtgacaggcagaggagatggaaactgaagtggtaactctgggaggggagacggtaagattttaaatgaaggagagggactgattagtgatcaagaaacaataagaggatttaatgagttcttttcctttggctaaatactcagtagtgagattgctggatggaatggtagatctacttttagctttgagaaaactctgtagtgctttccaaagaggctgtactaatgttagtactaatgtactaacattcccaccagcagtgtgtaagtgttcccttttcaccacatccacaccaacatctattattttttactttttaataatggccattctggctgggcggaggtggtatctcatggttttaatttgcatttctctgatgattagtgatactgagcatttcttcatatgttggttggccatttgtaagtcttcttttaagaagtgtgtgttcatgtcatttgcctgctttttgatgggattatttgtttttttttcttactggtttgtttgagttccttggaaaagagtcagggccaaggaggtgagagacctgagtcagacctgtactgttcctaaatgaattcagaatgcagtgatagtaagtttccattacttctcactatcttgtcggccccaaagtgatttgagcaaaccagactgactattatctgatcgtgaaggggccagataagcccccagtcaagttcaggtaaggccccaacttaagttctcactgctctgagagagcaacaaccagggaagttggttggctaaaggtttcactttagaataggggttttccagcttgtgattcaggatggcattacagcagaggaactggcagttttttattctctcagagttactggtaatgtttgttttggtcttcttccctttctttcttagtcagcaaaaaaatattctcttgggaatactcccctggtattctatatatatatatatatatatatgtataatatataatatatatattatatagcatatacaatacactccacccccaggctggagtgcagtggtgagatctcggctcactgcaacctctgcttcccaggttcaagcgattctcctgcctcagcctcctgagtagctgagactacaggcatgtgccaccacgcatggcaattttgtatttttagtagcgatgggatttcgccatgttggccaggctggtcttgaactgctgacctcaagtgatctgcctgccttagcctcccaaagtgctgggatttcaggcgtgagccaccacacccggcctagtgttactatacacttaaggagaagaacatgtggcagacatgggcttttttattttttgacagagtcttactccatcacccagcctggagtgcagtggcacgatctcagctcactgcaacttccgcctcccaggttcaagcaattcttctgcctcagcctcccgagtagctggaattacaggcgactgccaccacactcggctaattctttgtatttttagtacagacggggtttcaccatgtcggccaggctggttttgaactcctgggttcaagtgatccacccgcctcggcctcccagagtgctgggattacaggcatgaaccaccacgcccagcccaaccttggctttttaaacaaatcttcagaaacgttttctcccaaaaagtggttaagagcatggactctgcagctagaatgttttggttcaatttctgtctttggcatttcctggctttgtacctttggatgatttgcttaacctctctatgcctgggtttccccacctgtaaaatggaaacagcactggcataatacctaccttaaagagttattgtaaggttaaaataaggttttaattgtaaaatgcttgtgtaagtgttcagtgctctatgagtgttgactcttgttattattatcacttactgtttggtaggggaggaatggataagaacattcttcatacagaggccctggataaagtggttcagtttgcctttatttgacttcactctactccagaaacaaacaaatcaatactatttttttcctcctacttcatctcataaagatttcctttaattgatgtatgagcattttagtttaggagaaagttgattttgctattttttcttgtgtattatatgagcatatataatatctttcaattactgttccagttcatccagaggaaggtactcaagagttttttacacttattcacagctatgatgtatttttatctatttgtatacttcagtattaagcacttgttttaatttacctgttgctttataaaatacctaattgtcccttacgaccactccatttctttaggatcattattcttattatataaaagaaaatcaaggggagaagcttaagaagctgcctaagacaatagagttgttataaattaaaaagcaaaagttaaaatataggtattacctcccttttatttaccatatattagcaaactattagccaactagactacaatagataactacatgtactgtatttttttttcagtctgagtactgtggaggttacatctttactgggaaacttcgaggaagtatgcacatttcaacagacactctgccaagccttggaagaatgttcaaagtaagtgtggcatatttctgataggatagccagcaacattgctgtttgtgttttgttttccttttacctgttgcctttgataaggacacttcatagttaagtatttgttacagctctgaacaaagtagcaatacatagacagtgtactaggtggcagtgttcacagtgtcaaaccactagttgtatattagaagtctatatcttgtaaattacttttgactttatttaaaaaatacatcagtttgctgtttctggtcagtataagagacacataaggtcttttttttttttttaatgttccttaaagttctgggataaatgtgctgaacgtgcaggtttgttacataggtatacatgcgccatggtggtttgctgcacctatcaacccgtcatccaggatttaagccctgcatgcattaggtatttgtcctaatgctctccctcccctttcaccccactccccgacaggccccagtgtgtgatggtcccctccctggagacacatgaggtcttaattgaccatgaatgacacctctggcactgattacatattttcttttgtacattgcaaattacttggaaaagtcattcaaatgattcattcagtttcacagatttggtgtctttgaattgctcctgatactatgtctattatattaagagttgaaacacacagaaagtgggggaaggaaaagtatatctttatgtgaaccaacacatttttgatggctagctagattgtccagatgtttaacttcatactacagtgaactataatgatcatcaggcaatatgtctctatagaaagactaatttttcaagcagcgtatcttaaagaagttggcagctttcatctctctagggaaattgaggtgattacctgttatttaagcttaataggacacaggtggttgtccaggaagaacgatggagagggcccacactaaagggacttgaggggccaagagggatctagattattgatatgcaaagatgttcactaagcgagaagggcagattacaaactagattcataatccttatgttttccattttatagagaaacatgtagaaaaaagcccaagaaacatgtcaacatttttagagtcagtatctccaaatggtgggagtctgagaaattcatttttcttattacacttttctgatttttctacaaatgaagacaggtggcttataatttaaaacattaatttaaaaacttttgaggccaccctgcgtagcaaacaccaggcctccaagattacataatattcttttgtggtatgtcatttttggatttgattagttttgtctgtactcaaactttagataaattaaccaagaatatttttagtgtacccagctaaatttgaaaataatcatcttaaaaacaaacaagcaaccatacctactaattccaagtaagtatctgaccctatgtattacaactgtgtttggtggctagagtttaaagcagtgggcaagaatttgagtttcatgggtaaaatggttataatatagtttctcttttaaccttggcaaaatattcagaaggctttcatgctgccaggtttaattggaataatcttcctttgcctcctgtttcctattttacattctgtgttttgtccattttgtttacaggtttccagaaaaccagcacaaagtaggaggttgtctactgagtctcatgcctcattttaaatctatgtatctggcttactgtgcaaaccatccttcagctgtaaatgtgctcactcagcacaggtaaatagttaacatttccccaacttttgcaatgagatcctttcttaggaccacgtcatttggaaatccaaggtcttcagttggactcttgattatccctgttcatgatgccaggaattgattcattgttacatggattgattgtccattaatccaatgaataaattcttgagcacctactatgtgcaaggccctgtaccagctgatggggatacaggaatgaacaaggaggaggaggtccttcccctcattgagcacagaatcttgagggaaatgcagatattaaattaaatgttgtaaacgtgtcatattatgaaacagtaaattaaaagggttctgtgagataacattaacatgatatcaacttagtgggatgtgaagaaagggtcagggagggctttcctgaagcaaaattctatttcgagcctatcatttagctttcccctaccccaatgaatgttttttctgagttgctgacacatagctaaactgtgtagcttcatctctttttgccttccctagtctgcgtagagaaagttttaggcaatgatgtagctacaaagcaggtgtgagctgtgtgacagatactttaagcaaagggctctgataataattatacatgaatataagttgcttccgattcatgatgaacaatagaatagtgtctcctttaagaatacgagtccttgcaagggacctagataagtgttacacctctcctgccatccttagcttctgactacccacccctgacacattcactgacacattcatctgggccagaaaactgtaggacaggcttagtgacagaattttacctttgaagtcatatgctggaaatccaggtgggacaaaagcaagtccaacatatagagactcttgacttaacttggagactaagatgcagaatggacatggattctggaagctgttcaagactgaaaataatattctcttaatctgacctagatttgagctcccagagctaggctagaacattagttgacacgagcctccagaaatgacagaaattttggttcttgtcctggtttattaaggtgcaatatttattggctttacaaagatgttatgtaaggacattttaaaggttgaacgcagtaagtcctgcttgaaggtcaattttattcctctgataaattttgaactcttatggaatagcaaatatggaaattggagtttaaagaaagagaggtcatgaacctggcatttttaggcaagtggctcaactgcttatagctaacattagctagtaatagcactgacgatgtgccaggcacatgatgtaaaagcctatgagggagttattattattaccatctctgctttacagataagacattggaaggcttaggttaagtaatgtgcccaagaactcatagatcttaagtggttgagccagaatccaggtctgtcagacttctaaaaaatatttttattaagacatatattttatccacagaaagaataatgtaaatgcaaatttaaaggatcacaataaaatgagcacctgtgtatctaccacctggcttaagcaatagaaagttacccttttcttttctccctcccctcccctcctcttcccttccttttttttttgacagagtcttgctctgtcaccgaggctggagcacaactgcaacctctgcctcccagattcaagcgattctcctgcctcagcctccagagtacctgggattacaggcacgcaccaccacgaccagctaatttttgtagagatggggtttcaccatgttggccaggctgatctcgaactcctgacctcaaatgatccgcccaccttggcttcacttgacggagcaagactctgcctcagacaaaaaacaaaacaaaaacaaaacaacaacagcaacaacaacaaaacaaagtcactgcaccaatttattttctcactatctgtgtatgagggtttcattttctccacaccctcaccaaacatttgttattgtcagtctttttgattatagacatattagtggatatgaagtggtttctcatggtgagattgatatgcattttcctcaggaataatgatattgagcatctgatatggtttggttctatgtccccacccaaatctcatcttgaattgtcaaccctacatgtcgagggagggaccaggtgggaggtgactggatcatgggggtggttttccccaagctgttcttatgatagtgagttctcacgagatctgaaggttttataaggggctcttcccccgtcgctcttgctctctttcctgccaccttgtgaaggaagtacttgcctttccttctccttccaccatgattgtaagtttcctgaggcctccccagccatgtggaatggtgagtcaattaaacctcctttgtttataaattacccagtctcagatagtatctttatagcagtgtgaaaacggactaatacagcatctttcatgtacctactggaagttcgtataccttcattcaaagaaatgtctattcagatccttagcctgtttttaaattgggttatgtgtatttttattgagatataatttatataacataaaattcacgatgttaaactacgcaattcagtggtttttaatatattcacaaggttgtgtagccatcaccactgtctagctccagaacatttttattactcccctctaaaaacctgtccccagtaacagtcactcattattaatggctagtgatgttgcgcatcttttcatcttgcttattggctattttaatgtcttctttgggaatatgtctatttaaatcttttgctcatttaaaaaattcagttagctatcttttcattgttgagttgcaacagttctttatatattctggatattagattcttaccagatacatgtctaccttggagatactgtggatccaaaccactacagtgaagtgaatattgcaatgaagtgagtcacatgaactttttggtttccaaatgaatacaaaagttatatttacactctactgtatagtctattaagtgtgcaatagcatcatgtctaaaaaagcaaggtacattccttaattaaagaatactttattggctgggcgtggtggctcatgcctgtaatcccagcactttgggaggccaaggcgggcggatcacctgaggtcaggagtttgagaccagcctgaccaacatggagaaaccccatctctactaaaaatacaaaattagctgggcatgcttgcacatggctgtaatcccagctacttgggaggctgaagtaggagaatcacttgaacctgggaggcggaggttgccgtgagccgagattgcgccattgcactcctgcctgggcaacaagagtgaaactccgtctcaggaaaaaaaataaaaaaagtttggagtattgtaagaattaccaaaatatgacacatagacacaaagtgagtacgcacttttggaaaaatggcaccgatagacttgctcaacacacggttgccacaaaacttcaatttgtaaaaaatgcaattatctgtgaagttcaataaagtacactgcaataaaatgaggtgtgcctatatatgatttgaaaaaatatgctttcattttttgggttgtgttttcggtttcttgatggtgttctctgaagcacaaaaattttgattttacattttaattttgatgatgtccaatatgttgttttgttgttgttgcttgcacttttggtgttgtatctaagaaattattgcctaatccaggtcatgtagattcatgcctatttattttcttagagttttataatcttagcttttatatttaggtctttaattaattttgagttaatttgtgcatatggttccattttattcttttgcatgtggatatctagttgtcccagcaccatttgttgatttctattcttataaattgaagttgtgttttatggcccataacgtggtctatcttggtgaatgctccatgtgagtgtgagaagaaagtgtgactgttgttgaatgaaatattctacaaatgttaattagaaccacttgactgatggttctattcagttcaactgcctgcttactaattttctgctgctggatctgtcagttcctgatagagagatgttaaattctaaccacaatagatttatctctcttttcagttctatcaatttttgtttcatgtattttgatactctgttgttaggtgcattcacattaaggattattatgttttgtgggagaatttgcccttttatcattgtatatttttcctctttatctctgataattttccctgatcggaagtctgctttgtctgaaattaatacagctagtccagctttctttcaattattgttaataggatatatccttcttcatctctttacttttaattgtcatagattaaaatatatgttgtagacaaaatatatttgagtcttgtttcttaatccactctgacagtctcattcttttaattggcgtatttagaaaattcacatgttaagtgattatttatatatttggattagtatctgccatgttttctattcattgcaattgttctttgtttcttttttacctctatttttccgccttttctgtttttagtaaacattttattttcacttttctcttagcatataatactccctttaaaaaattttaccagtatccctagagtttatgttatgtatttacagctaaatctaacaacactttcacataacactacacaatttcataggtaacttataacagaatattctcaattcctccctcttatcccttataatattattgtaattcatttcacttttctataaagtaaaatcacccaatacactgttgctattattactttgaacagttatctattaaatcaattaagaataagaaaaatgaggccgggtgcggtggctcgcgcctgtaatcccagcactttgggaggccgaggtgggcggatcacgaggtcaggagatcgagaccatcctggctaacacagcgaaaccctgtctctactaaaaatacaaaaaattagccgggcgtggtggtgggcgcctgtagtcccagctactagggaggctgaggcaggagaatggcgtgaacccgggaggcggagcttgcagtgagccaagatggcgccactgcactccagcctgggtgacagagcgagactccatctcaaaaaaaaaaaaaaaaaaaaaaagaaaaatgaaatattttgttttacctggatttattatttttgatacttttttccatgtatccaagttttgtttgttgtttttaaatctatatcactttccttctctctgaagaacttcttttaacatttttgcaaggcaagtcatctggccacaatttcccacattttttgtttgtttgagaaagtattcagaattctaggttgtcatttttttccttcaacactttaaatatttcattccattctgttgtttgcatggtttataatgagaagtctgatacaattcttatccttgttcctctacaggtaaggtgtttttccctgtctggcttctttcaagattttctcgttgcttttgcctttctgcagcttgaatatgaaatggctaggtgtagatatgttttgctatatatcctgcttggtgttctctgagatacctggatcagcagtttggggtctgtcaataattttgcaaaattcttggcctaatagggtcaacattttaaatatttcttctcttttctctttcttttctgtctatattcccattatgcatgttacaccttttgtacttgttccacagtttttgtgtattctcttccatttaaaatttttttctttacatttaagtttaggaaatttctattgacatatcttgaagctcactgtttcctcagctatgtttagcctatttgttagactatcaaaggcattcttcatttctgtcacagtgttttttatttcaggcattttcttttgatcatttcttagtgtttctatcactctgcttacattacccatcttttattacatgttgtctatctttatctgttagaacctttaacatattaaccatagttattttgaattccctaataattccaaaatttgtgtcatatctgagtctgattctaaagcttgctttgtctcctcagactgtttttttcttgcctttcagcatgccttgtaatgttttgttggaaggcagacatgataaattaagtaataggaactgaggtaactaggtgtttactgtgaggttttctgttaatctgactaggatcttgcctgtgtttaatgtttgctgtagctgtaagtatgaggggctttagattttttttgtttcctttccttctctcttattaactttggctttctttctttcctttctttcctctttttttttgtctcactgtctcccaggctggagtgcagtggcgcgatctcagctcactgcaacctttgcctcacaggttcaagcaatgttcatgcctcagccccctgagtagctgggattacaggcatgtgccaccacgcctggctaatttttttgtatttttagtttagacagggtttcatgaagttggccaggctggtctcaaactcctgacctcaagtgatccacctgccacagcctcccaatcctgctgagattgcaggcctgagccaccgcgccctgcctatctttgggtttcttaagaactccttcttaaatagagtctgtgtcttgcagatccctccctgtaatccactgttattatatattggggccctgtcaatgtggtgataaggtgttggggaaggggacacattctataatgttatgaacaagtctcaattttttagtagacctgagtccctggaaattgacctccagaagcaattcttagccttttttagtcctctcacatatggcaggaagatgagagagggctgaagctggcctattgtaccttcctcaggtcagataagacttggcaacatagtttcccttggaagacaggcctttgttttggaaaaggttctgggattatttcaaaatggatgctccaccccgcccccactcctatcccaaaacatgagaggatttttctctgatcttcactatggaacatttttgggtttttggatcccaaacccacaaaagcattgccccgcctcaagatggttctccaggagcttttaaatctcaagttggggtccacattcagactccaggaattcattaaaatcactatgcaagtgttcctgccagttactgggtccagtggcttctgctttagggaagctaatctcagctgtaattctctgtattcactgtttctccagattttgaggtggtgattttttctgtgatctcaattctcagtaaatctaacaaaagtcattgattttcagtttgttcagtatttttttaattatgactatagtgtgatgacttccaagctctttcgatgtcagagctgaaatcagaagtgctttaatgattttttcactatattttatttttttattattttaaacgtttttgttataaattttctctataatatttcactatattttggggtgtcttttagtggttactctaaaactttccatatatatcttatcagaatggacttcattttttatgctaacttaattctagttatatataaaaatgtgactcctgtataactgtttcctcttccctttttgttattattattataaatatgaactccatatacacaataatacatgctataattgttatttaattttatgtccattaatacaactgagagaagaaaggaaaggaaaaatatatttatagtgtttgttatattaactttcttatttaccatttctatttcccttcattttttcctgtgaatttgtgttactatctggtattatattcttattccaacagacctttgctcccacctttctccttcatgctgtggttttcaaatatattaaatttatgtgtgtataggtccaacaatgaaattataaaattttgctttggccaattgcttttatatcagttaagagaagaagaagcatgtatttatactgtctttcataattgcatatttacctttattggtgctctttgttttaatatgtgaatttaaatttaagtctgggtttacttgctttcagcctgaaggtcttcactgagtgcttattgtaaggtggatttttaagaaaggattctcttagttcttgtctgggaatgttttcattccaccttccattttgaaagatagtttggatgaatacagaattcttggttggcagttctgtttctttcagtactttgagtatgtcatcccactgccttctggcctccaagattctgatgagaaatcagctgttaatattatctaggttctctagcccatgacgagttgttcttctcttcctgctttcagttttctccttgactttcaggatttttattataatttgtttgagtgtggacctctttgcatttatcctacttgaaattcattgagcttcttgtatgtgtgggttgatgtttttctcaaatttgggaattttagtcattatttctttgcatattttttctgctccattctctctctcctctctttttagtacttccattatgtatatgttcttttgcttaaagattttccatatttctctgaggctgtattcgtttttctttattcttttttctcctttttatattgcataatctctattgatgtattttaagtttacagattctttcttctgccagttcagatcagctgttgagcccctctaatgaaattttaaatttcagttattttacttttaaactctagaatgttcatttggttcttcttctttctttttgtttacaatttcagcatctttatggatgttctctatgtggtgagacattgtcatcatagcttcctttacttctttaagcatggtttccttttgttctttgcacatatttataatggctactttgaagactttattaagtctgacattttgcctcttactgacaatttctgttgtttcttatttgtgtaagttacacattgctgtttctttgtgtgccatattgttttttgttgttgagaacaagacattttaggtaattttagatttcacaactgtgatactgatttcattccccactctctgggacatgtttttgttgtttgcttatgtgtttgtttagtaactcgatttgactattttagtgaagtctatttcgctcacagagtacaatctctggtatcgctcttcagagggcacagccttggtcaggcatgcagtcactctggaatgacagtggtcttagcagagctgtctttgactgtctcactccctgatctctcctttaagccccgtttggtatcacatccaggtgttaggctctcctaatttccagctgattggctctaatatttttgataatttcatggggacataaattgctccaccatctgatctaattaagttcaagtggagacactttttgagactagactttgaggtttcttctgatccttcttagcacttcctggctgtctgtttccctggttctctctctggtgacctagctggcctatgggttagctttttgcacttaagtgacaggagctacctgcctccttttattggcttactaccaaaatctcctttgttttggcaagagctcttaagcttgaatatccccacatgccttttttccaaataaaaccaatttcttcatggagagcttcagaactcttctgttcccatggactgcgtctccctctgggcaaaatctcactactctgggagctgggcagcatgggtaccctctggttgcctcttccagcttgccttttccagcatggaactctctaccctacacttgggctggggtgagggtgattgggcctactctccagcctgtgtcggggctgcgtgaagtgagctttcgacctctcaggcacacttaccaggaatttagcctcttttacacagagttgaaggggagagatgtgctgatgacctgtccctcctggtgagatatcatattttttgactggtagctgagaggccagggaggcctctctacttggtcacagttgcccggaatggagcttctgtcaagctgagttgggaggagggagaaaagggagagctggtcatagctcaaatgctgtaagttctccctgttcttactgagttttagtagattttcctgaataaatactttttttcatttatcttatatcattaggacaacttctagatattttatttatttttatttttattattattggcttttcagagacaaggtcttgctctgtcacccaggctggagtgcagtgatacaatcataactcaacgcagccttgaactcctgggctcaagcaatcctcccacctcagcctcctgagcagctgtgactacaggcacacaccaccacactcagctaattataaaaaaattatagagacagggctttcactatgttgaccagagtctgctggtctcaaactcctgggcttaagtgatcctcctgcctcagcctcccaaagtgctgggattacaggtgtgagccactgcgcctggcctaaatggttttcacctgctacgcttttttttaactgagtagtgcatccaatgaatctcatgccaccatctcaaaagtggaactccttactgtttccttttctgtccttctgtgcccttgcctgatctgagcctaaactttttatcacttttttaatgtctcacttcacaattctaccacttagaggctgttttacccaaggcaattcacttcatttctaagccttaatttcctcacttgtaaaatgagggtcaaaccacctaccttgcaggattgatgttagtattaaatgaaataatgtatactaagcacccagcactgtgtcaccatgccctatgtgtcctttaaacatctacctaccagctactagtttctttttaggaaaaaaagtataaaatatttcaagcatacaaagaacagagataatataaagtacatccacgtacccactattcagcttaagaaacaaattatagatgcaattcaagttctgtgtatccccttcaatatttcctgctcttctctccctcaccagagtgaaccacagtcctaaatttgtttttgtcatttccaggaatgttttcatacttttctacatatctacaataaagaaaaaatgattcacagacttttttcctttgatgaattcataaatgtcctgtgaatataagggcaaattccttaacaccagtaaaatgagcacatgttctccttttgatatgaaaacaatattctggatgaatactggaaagaaatggtttacctcaagtggcagactttctgtggtgtttagagaagtttccattgtaactctatgtgttaaaatgttactgactacatttacctatgttgggaatttaattttataattaagtaaagcttccctcaaacattatggtttgatgtttgttacacagttgatttaaaagattctcaagtttttggtgaagtataatgccctgtttaattttagttaacggtgtttttgagaattttataatatcccttgaaatgatggaagactcactggagtcctcatagaactaaatttttatcttactggtttatttacaggtaaaagggatgaaaattaaaatacttgaggtttttctcacatgtgcttttaatataatctcaactattttacatgcatctagtggcaatttatgctgacctattaaaggcaaagcacagtgaaatgaaattcacagaaaattcacattaaacattttttagatgaagatttcagctgaaatagggacattggtggatttctgttctttccttgctgaagctgtgatgttcaggtgaacttcttcctttcggcctttaggtggcaataccataccaggaatgcttataacaattggccctgagaagggatccagccttaaaattgtatgattgcatgcagctgtcttgttaaaaatgcagtcgtgtatggcctgaatttggatatgtaatcagaccccaaccttgatgtgtccccatatttgcatatatttgaatggccgctctagtcttttgttgtcccctgggtgaggtatttcgggatttcccctccctctcccctgctagcttgctatggtagctcctgtttcttcctgggaataacctctcttttacaaaaataccctcttctctcctgtgcttgcttcagtgtggcattcatcctttttcacgagggagagggttaaatgagagatcagagagaagaggagttggtgctaagacagatccggacctcacttccgtctctgctgtgctgtgcttttgctcttgttagttctctccactctttgtttaccatggttgccagcaatgaagactttgagaaaccccccaaaaagttgtgtacttgctctgggggcagggagcacgtaaaaaattctgagcctaggttctgttcttttctgtctttgaagggccagagaagggagcaagtaagactgatcacaaacaaaaagtggtagggacaaggccgggcgcggtggctcacgcctgtaatcccagcactttgggtggccgaggcaggtggatcactggaggtcaggagttccaggccagcctggccaatatagtgaaaccccatctctactaaaagcacaaaaattagccggatgtggtggtgtgcgtctgtagtcccggctacccaggaggctgaggcaagagaatcgcttgaaccctgaaggtggaggttgcagtgagccaagatcgcaccactgcacttcagcctgggcaacagagcaagactgtctcaaaaaaaaaaaaaaaaggagtggggacaaaaaaagaagcaaaagaagcacaccacctaatatctggggctggataaatgaaaaagagaagaaagggaaccactctacccagtgtgagtggcactcttgaaattttccactggccagaggctgtggcagccagctcctcttgcctcaccaccccttttggaccacagtgatttcccccgaagggctggtggggtagtaattgaggtggagaggaggaatctctgaccttctgctaggtagagttatgatcattcaaattagaaacctatacaaagatgccacagaagcacttctatatgagatggctaagctctgtagtgttattatagtatacatagctttcttcagctttccagtccaacccagaatatcccagagccccatccaccatgcattctatgaaataaatgtatgttgttttaaacagcatttatacactgagaactgcttctattgtatcatgtcacatatacagaacattttaagcttgaaaagcaagtcttaatccactgctatttcaaatgggctgtataaaattctacatttaaaagacagattgttctttggtataacaatatatatttatgtattatatttgtgtataatgatactaatttgtgtattatgtttatttggctaaataaaatgtgtcttttaggatctatttatcatagataaaaggcattttaggacaattttgttcttttgttgccctagtaaaattatcttttctgaagaaccagtgttttaatccaagatagtgatctcatgttgtactgaaataaatttaaattgttttatgatgtttagcaagcctagaagttagaatgctgcatggaaggtaataataaggtacacattagcatttgcttttaattgctttcactcttgcatcaattagagtaaaatgttgaggatgcgggcagtcatttagtcactgaaagaaaaaataaaacttgtttactaaattgaaaagaaattaggaaaatgattttctccaaattacatttctactcaaatgcactccaaacccgagttatttccctaattatattttatatgcaatgaatttttaaacctctttatgcactttatgctcttggttggcaattgaacatcaattgaatttccattaagttggaaaccacaggtactggtagtttttaaagatgtgattttagcaaggtatttgtcttgggataataataataataatgcatccactgactactttaaagtttacaaaatcctgtcctgcagagagccagtatggcatcctaaaaagacctgaggctttggcttcagacctgagtatgaatcccactgtagccacttactatcacccttcctctcagttttctcatctgtaaaatggggagaacacctatgttgaaatgttgttgtcattaaacaagaatgaatgcatgtacaattcttagcatgaaatagtagcattaaaacccccaatatttaatctttgcaattttattaggaagtaggttttatctctcttataagcatgagtcagttgaggctcaggcaactcatccagggttgccaactctcttttatgactccaagtctaggacatttccctccctttggctacttctggaacaagactacgaaaactgataaaaggattagcagcaggctgggtgcggtggttcatgcctgtagtcccagcactttgggaggccgaggtgggaggattgcttgagcccaggagttcgacaccagcctgggcaaaatggcaaaaccctgtctctataattttgtaaaagttttataaaaggattagcagcaattgctagatatgacctctcatatgtgatctagactccattaaggcagccattcccagcccaacatatgtgccatactgcatgactcaaggctgctgttgcattagctgaaactccatcttttctctcctgctcagaaaagcccacgaagggagagtgtgggtggggattgcagggataacctgcaatccgctctgtttccagcctcctagtactttattactgatagcaagttttttgaacacacttcacaccttatagcagcacaccacagttgggaaccatggcataagacgtgttctagggagaataagtaggtcactttgcactaggggtttcctgctggggagtagtgagaaagatggtggagccagtaggagtttaaaaagttaagacttgatcttgtaggcactcagcctcttgggtaggaaagcagtgaggctaaaatggtagtctgtaggacctggaaaaagcctggaagccaggaaaacagttggtctattgaagtgagccagatggaatgagctgaaatcctgaactaaggcagtggcagcaggaatggaaaggaatgaacagatccaagaagatttgtgactgactggatatgcatggccaaccaaagaggtaaaagggccatgtaataaagcagaagtttcaacataagctgtcacttaggcagtaggtttcctcctctaagtatattttgcttaaatatgtatcaaaatgatcttgcagccccaggactcaatatccctgttggtggaaagtaaacagtttggaacggtgctaaacagcagaaaaagcactggcttagaattagacatttacagcacacagttcataaaatattaatatattttttcaccaagttactgccttatggaagtgtttggttaacctgcttcactggtttttgatattgggctaagtgactttgtggttagtcatacaaacatgctggtatctaaatgcaggaagtgattctagaacattacaagtgggtgatacaaccttgtggattgttatctttaggcacctgaccagccaataactaggacgtttgaagtgattaagaaaatctattttttaaattatactttaagttctgggtcatctgatacactgtatatctcacgcccatgaatgtaggctccttaagggtggggattttttttttttgttcactgctgtagccccatcagagaacagagcctgtcacttagtagatgctcaatcagtaattgttgaatgtgtgacaccagggatcatgagtgtctggctcaccaaaggagccctggtgctgattttacagaaggagcttaataaaacctgatttagttgagccaaaacaaattgaacagcatttggactagtaaaacacatttttatttggctttatattgtgtgaaatacagtaaaataattttaggttgataattctttacatgagatattcaacagtaacaaaattatatttgttcttttgctagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggtaagggaaggtgaactttttcaagctcgtgtgccaagtatggtcctgtgctctggaggacgcagccaatttgcctccaaaatggccttgcagaggaatcaaggtcttggattcaaaatttactttatctgttcttccctcttctcaggcttctagttttcctttttatgcagcaaaataagatccttactctttgctactagatattaatgatcattctcccttttcgctcttctcttccaagccttggtcctgtggcttcccttaagtctatgcttacttgctaacttgagttttcttttgccctctcagtagtttggtcaaaatccaactaagaaatcttctttgtttctggtatattaaccaactttattgtgggagatagagcaaaacaacatcagaatgtacaaagaacaagttcactatagacaggaatatttatctctagaattctgccatcattcaacttcctgactctggataacagtggaagattctggtattccttaaagactaatggatggatacaatattagtggtatctctctacacatcatgcatgtacatcagagtccccccacatttttatttataagcctacagtttacttgcaactgttgtagcatagctataatcttttctaaattctaagattttgcaatgaggcctgataattgaatattttttcaccaagaaccaaaggcctcatgttatgaaaaaccaatcagcagagctagctccttgagccattcttttgtgattgttcatgggggatttaagtgtgggtgggagaggagggcctgctggaggaggctgcatttaccctagttgctcttcctgtgtctggggaaaggttttgaggtttcaaggggtttgattatctttaaagaaaaagagtgcacccgcactctgccgggcttgtcagcatttgtaaggattgaaagaatgttctctgagcgaaaccacattctcagggtatttgacctgcctgaaagccggaggcagtggggagctggtgagcaaagcctgtcagtgtgaaatttcagttagggctcaggaaggtgttgacctctggatgcctttccataagctaaaccagtttgctgaaccgtttgaggtttgcccctccttgcttatcacaaaaatccagaaacgagtggcctcagtttctattacttttcagtgttgaaatgcaaatatgcacttattttggggagaaacaaatcccagatgctcctgctgcctggatcctatatctcagtctttcttgtagtggagcctgttctcctcctgcttccatttgctgtgggtcacatgtctttggctgcctctcatttcccatcatcagaaaatacaagcctttagaactagttcaccactgggtgagacactttgtgcagatttcagagcatttggcatggctgctaacagtagaataaagcctgaacttcttgtttgtcagttgatttggataaggataaattttactgtaaaggaatacaaccttactttttatgagcaatgtcattcttggcttgggtcaggcccctaatctgttcagctctgtattttatcacccgagactagtggggcaggagatttagtcttcccttactccagctgagttccaaaggacatatcccctatgccccaatgttaggtgcacatctacccataagaatctgtgtcttcccttcataaacagttatggaattatggattcctctaagccgtttttgaatctgtccactttcggaattgcaagtaccacaggattgcaggccatgtgtaagagccttgcttaagaaggaaaatatggtatgaaacttggaatcttttcccatctgccatgttcacactgctgaaagaaaatggaggcattttaggaaatggaattagattgatttttctcttgagtttttgttgttgttgtttgtttgtttgtttgttttgagacagggtctcactctatcacccaggctggagtatagtggcacaatcacagctcatcacagtctcgacctctgggctcagctgatcctctcagctcagcctcccaagtagctgggactataggcatgcaccaccatgcccggctgatagattgatttttctctaaccacgactcttgtttccaccattccctacctcctgtcatctaccaacaacatgacctaatgatgtaccccgaataattatttaattattatatttattattaaataatcattatccaaagtataatagcaaaaagggaagtgggaactcttgccttttactacattgttactaaatatatgatgcattaccaactctcttaatttcttaatcacctaataattagagtcactgagattccaaatgctcccatgctgctctattttttaatctttagtatagagtaaaattaacgtttttcttctggtgcacagttctatgagttttcacacaggtatagattcatgttaccatgaccacaattaaaatacagaacagttccatcatcccccaaaattctcttgctatctttgtggccatactctctttctacccctaacccttggcaactgctgatcctctctcctctaacattgttttcaaatgtattcctttgataggatactcatccagatcatcaggatattctgaaagcaatcgtagcattcaaaactctcatggtaggtgatgctttaaaatcacaattctccattttgtatactttattcctgaaagagcgatttgtgtgtaacatttctttccctatacaaaggtctttagaatggaaataagctttcatgacagtatagcagtgattgtttcacttaattttgtcctccaaaaatcatgcttacctaaagaaaggttgccaggctgagggtataaagcaatcacatttacagtctcagccacattaagccacattaagcattggtgtgtaggtggggggtttccttttgtctctttgtctttacccccattgctcacctaatgacgagtctgtgtaactcatcattcactgatttgcatcaatactggattcaactagttatgccaaagggtatgagttttttctttgcatatgaagaagaaatccttcatcaaatctaaaaggggggaaaaaacctaaagaactaaaatgcaagtgctttatataggttgctatcaaaggtacacgtgatcttgtatcttcagtatgatggttaatgtatcttcttgaacccactgatataaaaccacttggtgccattttaggaggaaagaaaacttcattttgggcaattgattaaacttagcttcatttcacacaattctgtagcattataagtgatttggactaatgtttaattattaatccttgttgaaagatcagtaattgacgtgtctgtagttgaacagtaagttgaagaccagagtaagtattagattaaaattgccattgttatatgccaaaaacagtccaatattggcagttttacatggcgcaagctaatagaacagcccagtgaaacccacagcatttattataattatggttcttctattttttcttgtataaataggaatgtaaaatgagtctttttaaaaacctgtatttctttctgattatattatataacttgccttgatggtttagtatatttattcctactataggtgctcttaaaatatgtgtacagtgaatttatttctttgagtttccatgtagctgaaagggacagcagagattttatagaaaatataaccccaaaatattatcttacattcatttggaaacagtaacagaactaaccatgtgcttatttttgtattcaatttggaaggcatgctgttaaattactctaagataacctcacagtttcttaagcagtgagatatatatatatatatatatatatatatgtatatatatatgtgtatatatatatatgtgtatatatatatacacatgtgtatatatatatgtgtgtatatatatatatatatgtgtatatatatatatatatatatatatatacacacacatacacacacatatatatagaaagagtattcataccccacatagtgttggcaaactgtaattttttcttggtttgaaatttcagtatgtcatcatgaaattcagttgtatctcttttttccaatccttttaggaataaaaactaatttagtatttttttcacagcaatcttggtccttaaacaaagtacagcagtgcctaggtttcattataagtttgattcactgtggcataaagaatttaattttctctttcactataactccaggagaaattttttgttttttattattttcaagatgttaccttgttgaaaattgagcatatgttagaaatacaattattttgtcactaaagccctatttatgcaaagatagacaaggtaagaggagctaaagcaggggcaccaaccagtagatctgaatctaccaggtcctcacctggctctggtcagtgtgatttggctgcttgctttcccatattctttacagggagggagaaataagctctttctagcattatgttttgatgctttggcaaaatgaaaaataggccttcctcacaaaacctttgggggctcaagcctagagatttagggtagtggatctttctgtctatcaagaacaggcctgggtcatgggattcatgatgaggaatagggactcagtgggaaccaaagagtcagaagccacatcttactttggtcttattttagtctatttcataagaattcctattccattatgttctgctttggttctgtaggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggtaaggtatttcaaatctcaacattatttcttccatctttcgtatttttcttccttttttttttttttttttgacggagtcttgttctgtcactcaggctggagtgcagtggtgccatcttggctcactgcaacctctgcctcctgggttcaagcaatcctcctgcctgagcctcttaagtagtttttcttccttgttcttccatcaaagtcaaatgctacaacattcaaatcagaagctgagcacctgttctttgttgaacattctgctaggtgctgtgggagataggagaaaagaacaagcaatgatccctgttttcaaagaactcattaaaaacagactaaaacacaagttgcaactagctgacaaaccaaatagtcaatgttcgattttgcaatctcaacaagagtccatagaagttcacaggagggagagatcaagaagaccttacggagacaggacttgaggagggggcacaaaaacaaaaggggaggatttcgcaaggcagaggtcattgttatcttaggagagaacagaaatgtggctttggtttgctgcagcacagtaaggaaaccagcctgtagggagcaaaagaagcaacttggccctagtaaaagattgattgagtcaggtagaattagactatgcagaagcttgacatcaggcaagagtagttcagatggatgcaacaggccatgggaaataatgaaagagtccacagtcatagaacaacactccgaaagggatgtttcacactaatctgcgacctatatatgtcaaatgaactggagggaatggacgagaagcagaaaggccagctgggatggaaagtgagaaggagtcccctaagacggtggtaacactgggaatggagcagaaggagcaaattggaggcatctttagaagggaaagccaacaggaagtggtgcccctgggttagaggagatgaagaatataattttagacctgtagatatctgggtggagatgtcccataggcagctgttaatgtagtatggaaatgtgagtgagaggtcagagttagaggcagagacttagatgtccctaacagatgtgccttcctaggaagtaaatatccagagagaagcccggggggtggggggagctgaagatggattatttcttttaggaaggagccagggaaagggagaaaggttgattatggcacctggtttgatgtatcgggtgttagaattgtcttccttctcccaaaacatcttcctacgctctctgacacgtctttggcggagattcattactttgggttaataagcaatctcatttaaaatgcaaataccccagggaaggttactgcagtgagtctaactattagtcattcacacctttgggataaaccccttgggtgaaggcaggaggaatcagtgccagaaaaaataaaaagacaaagaggaaggtagagaagaactgggggagcatggtgtcatggaaattccacgaggagcatttgaaaatggccagtgtgctgactgctgctgaaggttcagagggcaaggaatgtgaagaccaagaggaagccattggattttgctagaaggcagttactgatgactttccaagagcaatgggggtgcagttagggatggatcaatgcagagaaaatgaaggcagcaagtaatttgccaataaaatgtcaagaaatgggatattatgcataaagggccacatgggggcaagccaaggtctgttaggataggaggtgtacatatgttaaagaaaaagaggaacagctagtaaaagagaagaggatgctgggagaagaagaggtgtctgtagaggaaaactaagtgaaacaaagatgtgagagaatgtggagcacttgttagaatagttagcctggaagggttgctcttctcaaatggaaggaaggagatggagacaggcataaggataattgtagctaagatggctgggcatggaaggcaaacgtaatttttgcgtatactaattgcatatctgttgaaggggctcacagcagccctcacgtttcaaggtttcctcagtgccattaaaaagtgtatgggaggctgaggtgggtggatcacctgaagtcgggagtttgagaccaccctgaccaacatggagaaaccccatctctactaaaaatacaaaattagccgggagtggtggcacatgtgtgtaatcccagctacttgggaggctgaggcaggagaatcgcttgaacccgggaggtggaggttgtggtgagccgagatcgtgccattgcactccaacctgggcaaaaagagcgaaactccgtctcaagaaaaaaaaaagaaagtgtatctacttttatgttttacataaatccaataattatcttgttcttaatgaccaaagctaattttatgaatacgactttaacaaacatgttagagcatactaaatctcttatcacctgaaaaccccttcatcttgccattttttcaaagtaaaatatattttcattttgtgaacctggagacttattttgtgcccaggtctagcacatctcactggctgcataaactgtggtgacttctcaggctttcatacatggaaagcaagcatggttatttgtatttaattgttatgtataagaagaagagagataaactgtgggtttatgtccatgtcaaagtaaaattcaactagttttgtgttttcaagttgggtatcttttttaaaaaaaaaattaccgttaatgtttcagttgtttatataaggtctatgttataaggcagtgattccagaaattctcaacagataaagtgtccaattctgttcttcatgtattattttcattccctctcaggaaaaagaggagcggtaccttatgttattttcaaatgtcctgataatgttatctgcaagtcctcggatgagtggctttatctatcaggttagtaaatttcatataaaacacatagcagaccccctaacgaaaacaggtttccatccagatgcaatatctccactatggcattaaaagctcaagccaggagaaccagaatgttctgacccttcattgtaattaaagagcttgtaagagcagatgttccttagatcaaagacctttgtattagtataatgagtttatcttgaatatatccaccgctttagttatgcactaggttttgcatgcataaatggaaactagataaattagcagcagtattgtacaggcccatgtcattattgctgagaaaacataaagctgggacctgctcctatgtttgtcttattatagtcacagcacatgattcaggcttctaagaagcatgttattaaactccttaggaaattaaatgtccctcagtcagctcccaacatatagagtattataagttactattgcctgttccatcttggcctggcaattaataattttcataacatctgagccttcacttttttttactgattcttatgaaaatgtgttagaaaagtaaactgctttgtaaatcctgatcttatagtttagggtgtgttagccaaacacaatccacattttccccttgctttcttagtctgattaaaatttagagcagggaaacatattatctattgacagactggagaaatacgtctagccatagttttgccttgctgagagggtcagaaaatctaagtgaaataaacagagacctgtataactgcagaattaatgagaatgttctttttctaatagggaaaaataccaatagcaggaacggtggtgactagattagatgaaattgaagggaatgactgcacatttgaaatcactggtaggtaattttctctttttcatgtaactacttccaattctttttggaatgaaggggaatttaataaataaatgccattatttcctgttacataggccacgagcaaattttatgcgggcatggcaaagtatattccatttcctgggataattagggtacagcaatagcacagagaagtctcctctcattcaaaagccatggctttgccattagtttcaattttctgttgcatgagagctacttgtgagagctaaggaataacgaaatggactgatgtaaacgcaattttcttcccctctgtcatttgttccctggtggcagaggagccaaagatatggacttttatcagcaattttatcatcagcccatgagttagtaagatttggttgtatttctaaaaagttctgaaaagccatcaaattttcttcacaaattgagcataatgccaggcttcagtaatgccccctgacattttagcttatgatcccttttgccaggtctgtgtcatttatatgtagtggcctgactgttggtgctgatatggcacagtggctaagactgggatcatggccttaccctcttctttcccaagaaggagcttaaggtttggtgtttgccaaaaggttgtaaatagtcttagttggatcttgttccaactttgataccaggggaaccaggacaatattcccactttagacttaactagatggactatgtgcttatgtttttggattgcaagtttgtttatggtgaagttttacactacttttaagcttctgtaagcagtaaaaatcaaggacagttttctaaatcagacatgaatatttatttactttgtaatcacaggttatctgtttctgatatagaaatttcagcagggttatcccataggtatgaaaacccctgaaaatacacacccaagtcctagttgtatgaagtctatttatgaatgggacaagctcaagtttttccttgccttttgttttcaaactgatcataattgggggatgtaggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattctgtaagtagtccatgtgttctgtccagagattattgagtctttcgtcaactcctgcctgctggagacttacaagaagcagcgagcacacccttagtcttttgggcagcctatatttgtagattttgaagtacagttaaacctcactcattctgatttctcattatgaggcccatccaaattaatgaaaaggtttacttagagtgtgcagttctgtttgacagtattcagataccccaactaactgctagcaaagtatttctaaccagaagtcctgctaaaatattttaatgataagcaaggcttatttccatgagcaatggttattctcctactaacagtgggctaagtcgaaacaaatagtttacctccctaagtacttaaacatctccatgtcatctcactcatgctctcacatttgctcagtaaccttcttcaaaggtaaacttttagcattatctccttctgagttatcacaaatttagacattggaatttgaattgatgagattttactgtacttgctgagtgagatggaagatatgctgtgttgtttgttaacatacaaacctatgatgccaaaattccagttttgaggactgtgtgttgtggttggaagaatatggactttggcttcagatctgggttcaaatcttggctttgccaattactagttagttgcttcccttgactgagtctatgtcttaggctgttctcatgaaataacctatttaagcacctactagagtgccaaacatatcactgaactcaaatgttgactgctactccattttccttccttacagaggaaagaaaattaaattaattaaattccagatgagaaagagaggacaggatcatggaatgttgagtcaattttgtgctgtttcttagagacccgataatctggactggaaagaaccagttctcaaactagagacttttgtttttccatctatccctttctatggctgtctttgctaatccaatgaagctattgttgttctctcactgtgtggcacaaggtcgggttcagatggcagattgccaacatctcatcagacattttcccagtcttttagctctaccggacagccccgaggacccttggagcctcctcaaattataaaaccgtggagtttaagttgtctacgacctgcacctccacttagaccatcagcagcactaggttataaagaggtaattttgctacctatggtataaaatgcttctgacaagttaatttcgtagcttattacaaatagttctgtgggaatgtgctagaatttaagatagatggtattatgtgagtcagtcttgaattgccagactcagtgatttgtttgatttcttaattttccatttcccattgtccatctgcaaatatgtactgaatatctacaggatctatgtgcactgcctgagtgttcccagtctcctcctgaagtgcctctggtttaccttaatgattattatgataatcctttagatttgttaataatgtacacaaatctcaaacaagagccacttcattgtagttgagttgccaatgaagcagacttaattcagcatttgggatcattttgatcaatttgaaccaaattagtaaagtgttatgggaccaagctatgagtccaaactataaaagtgatatttgctgcaattggaatgagaaaagaatttgatgaaagcagtgtcttttaaaaagaggcttctcagagacaaccttaaaggccatttgatatttgggtagtgtggggatttaaaggttttgtgtattttttttttctctcaaagttgcagtcaggaagtgtcactcactagcttctgtaactgtgtggagtattacttttccatccaaacagtggctttatccctaacctgtctcaaatcatttcagatttcagaaatgatgctcatttattagtaactgttctttaaattggtcttgttgagtgaagattaagtttgtgacagttatgagatgagtcttagaattatggggcaaaggtggcttatatttctatatcaaacgtgtgttttgatgagtgatgcagacttagctcaattttgagtgttttgattgaaaccaccatgcttttgtttcgattaattgttgctaccaactctaagtgcagtaaaaataggacaatatttggacactggaggattttttgatcctttcaacttgacatgataggacaaacaaccctcgaactgaatctttgttatataactctatttagaatttggtcaggaagcagtcccacagatttgctttggaaatttacgtgcaattcttgcaatcatccaattttcttctttgattatgtaaaccaggagtgccacttgatagttacctaggccccctttttaatgatggatattttgtaattatcagttactaagttcaaattaagggtgagctttgaagagtaaagttgacttaatccttcacaaaactaatctattaaaactaaggcatgatcactttgtttctgctgggggaagagagttattaatatattcctactagatagtatgtatttcagttgttttcagcatttgttattctgcacagaactgtattcctcgggcttttgcatgataatattgcatctgaaactaatgtgggaaatgtgattatattccctctgtgtaatttatgataacactaacatttcaaatgttgttttagaattattgataagtggatttggtcattataaccatcgacctctcacgctcatcttctctttctttacatattcattttagaggatgtcttatatcttaaaggtaagggtagtacaatatctttggcttacagtgacatcataatgctgtactgtaacctttgatgaatgaagctttcccttatgcttgttttgtcccttgttataattggtggctaaaatatgaagatgcaattttgacatgtaagtactttgttcaaaaagcaggcttgtgtgaaatacatataaaaatgtcataatgccctaaaatgcccattttcctgtgtttttttttaaattctgttttttcctgttatttttgtcatgtgagagtttttcatatctgtcttgttttcaagtgtaagtactgtggctaagtgaaataaattaaatgatttgtttcctatatttttaaggtactattaataattaatatccatgctccatgtatacacatttcttggaaaattgggattaggtgatcatgagagttttttcctaagtctaaggttgtaatctgtttacagattattggattaaggattaaggatattgacaatgagtatttttttgacctgctggttactcatatggcaaaaacaaattcaatacatttattttgtctactagttaaatacatggctttatatatggatagttaagtttggctgtgggtgtgttacttctaacccaaaattattttttaggaaatccttcatttggttcttctctttgactgcggaaaaatggcttagtctctctgccttaatttttctgtctcacaaatggaaattatattcttatttgtgggactgtttctaaggcagaattatttaaatagctttgaagctctttgaaaagtgatcattactacattagtggttacagtggttatttagttcccctaaaactgtatcagtggggaacgtaaaccaaattaggaatactgttacgtttttagggttgacatcccttactttctctgcagatggttccctaaagccatttggcctcctggagaatctgccacatcttcagtaggcacactccactcttagtcccacctctgtgcaagttgagaggataatgtcattgcctctgttttatttaaccttttagagtttattggaaccattttaattgtgcatagaattaaacattgatgtactcctaactgagactgtcaaaataagagagaggaattctacttagtttcattcatgcttttacttttgtttttgagggagaattttaattcattaagaaacctctgtcctcacaggagtctagtaaaagccctaaaacgatgaagaaatttcttcataaaaggaagactgagagaaaaccatcggaggaggaatatgtgattaggaaaagtatgtgttttgtactttctgaaagttgtttatggataaattaacatgagaatcttcttttatgtgaggatttatttgaaagcagatgattggagcaattttttcttgacatcgtcttttacatataaagaagaatgcatggaaagctttggtcacttcttaaacatttgaataagcttcttacggctgcacttcatgtcatcttaggcagatgtcatctgtatcatttttgtgttgagtattttgcctcacctggtttagaacctctaaagggacccatttcctatggatacattttttccctcttagtttctgatacttgagatatttttctgcagggagatagactaaatagacccgaaggctgaagtccttccagaagtcccatgctcagtgatgctctcagttactcagggaatcagcctgcccacatctagaaacatagtttcatttggagacagactgcaaagtcagtcagccagtcgatatggacatatttggctataaggctgtgaacaaggtactttgggacacaaggtactttgggacacatgtgaaggagtaagtgatgtctcacaaagaggtgacagaattgtgtgtatcagctgggaatatagtttggataaatatttgctccacttcagctttggcatgccccaccccccaccccacacctggttatgcacactggcgtgttcacagggtgctgccatccagccattgcaagaatgagtttggagtagaggagaagggagaagggaaaatgagtgactatgctgactggttagaaaattgggtggggttggccgggcacggtggctcatgcctgtaatcccagcactttgggaggctgaggcgggcagatcacaaggtcaggagatcgagaccatcctggctaacatggtgaaacctcgtctctactaaaaaaaatacaaaaaaaattagccgggtgtggtggcgggtgcctgtagtcccaacaactcgggaggctgaggcaggagaatggcgtgaacccgggaggcggagcttgcagtgagccgagatcgcgccactgcactccagcctgggcaagagtgtaagactccgtctcaaaaaaaagaaaagaaaagaaaagaaaattgagtggggttaatgagggaaagcttcctaaaggtgagccttgaaatttaaaggagaggaaggctggggtatattgatgggagctaagctagcaacaagctcagtgctgtgattttggcctcactgagaccactgacaaaacaccgccccccccaccccggtcccagtgtagagctctgggcttcaggagtaggccctccactaagctgagctcactgaggctgactccaaagctccatgaggatgctgtcactcttctccatcaccagcgttggacagctctttctcctgcctttcacaaactctactggtcagagaagccagtcccaggcagtggagtgtgctgcatcattttgagggtccaaaagcatatatctatgaaaagtcatgatgaattaaatttcacaggtacagctgctctggaagaggatgctcaaatccttaaagtgatcgaagcctactgcaccagcgcaaattttcaacaaggccatggctcaagtaggttcccccaaactactttctctagtgagtgacgtttcttccttactgtttagtgtcttttagaaaaagagaaaagcaacccggatgggttgcagggtgtggaaagcaggtgacttggtgcagaggagtggtgcaggactgcatctttcagataaggtggttttagctaccaagcggtttgtttacccactgttgtttttcacccagaaagagagatgcaagagtaaaagagttggaggtgatagaagtgaaaatttttttttaaagttgttctcctttgaagtacacagataccttcaccaacactagttaggaattaaagggcctagagagttcctgtgtctgtgaactgatgctaatctcttcttataggcagatttggaaaggaagtcaaaatactatctttgatcagctgcatatttaaacgaacaatgcttcaccaaactcaagtttcaaagttgctctgaaaatctggaaaggtagctgcttagcagaggttgtccaaaatgtataaagttgatcagggagttattaggttagggtatttccccaaacaactttcaggttacaaactgaaagcaagataatattttctgattcatctttatgcttttaaaaagacaggtcacttcgattatgtcttttgtctcccattattatagacattcagaataccttttgtgaagtttttgcacctgcataagaaatgaatactccatagtactccattttggacatccagtgaccaatcatttgaatgtgggaggggatttcttaggtgccttgacatattctttcaaagtaatgcatctctaaggctgacataaaagaagcattctactgggcatgatggctcacgcctgtaatccagcactttgggaggccaaagcaggcagatcccttgaggccaggagttcaagaccagcctgggcaatatgggaaaaccctgtctctactaaaaacacaaaagttagccgggtgtgatggcgcacacctgtagtcccagctacttgggaggctgaggcaggagaatctcttgaacccgggaggtggaggttgcagtgagccaagattgcaccactgcactccagcctgggtgacagagtgagacaccatcaaaaataaataaatacaagagaacgagaggtggggggagagagagagagagaaagagagagagaaagaaagcattcaatgattcaatgtgaaagttgacgcatttggccatgaagagaggactgtcgcactctgcttcacagagaaaacctggctgtggctttgggcatgcatagctctgataacatgtttcaaggagccaggagaggaaagtgagggcagctttagttttgagaactagagaagagagggggacaaagagataccagaagcatcccttctacaaaatctgacctcatctcctcccgcaccacctatttttatatttgacagagtggatgggtctgcagctgggaagtgcagccagatattctggcttaaaaagacacgtcttcacccttgctccctacccaaccttttacatgtggaagatgtctggcactgtgcttgtcacacagcagatcatttagcatcgtggtgaccttctatcctctatccctctctaaccagaagccctgtttctctagaactgactgccctcggctcttactgcattcagccagtcattcagtcagtttgctttccacttatattcgtcccttggtatctgcaggggattggctccaggacccccagagataacaaaatctgacgatgctcaagtccctgatgtaaaatggtggagcatttgcttatcacctccatatatcttcccatatactttaaatcatctctagattgcttatcatacctcataaatgtaaatgctgtgtaaatagttgttatactgcattgggttttaaatttgtattgttttttgttttttctgaacattttcaatgcacggttggttgaatccacagatgtgaaacatgtggatatggggggccacctgtattaagcacctacaaagtgctaggccctggagaaggcagagacacatcttacctcaagaaaggggaggtggtcaagtgaaggcagtgagtgtgcacacctctgaaggaacttggcctagaagagaggaagccagtggctcagggagacccaagattaagcacttgagctctgagagggaggatccagagtgagggaggtgcaggagagctgtttggttgggcccccatgcctgttctgtcacctcttctgtcccagagcctggagacattctgggcagaggacacctacatctttgctgatgatgtgataatctccaaacctcactccacccttgatgaaaatggtcttaggagacatacctaccttaccctataagactgtaaagagaacaaatgggggtgatgatgcttctgaggccctttaagcacattgtgtttcagtgcagtgctactgtcaaccttttactacaatgacaaaacactgtagcataggatgtagtgtgtccttccttggagatttgcagggaagagtgatcactggtcagctctttgctctggaggaggcaaaacaggaaagaatggaggtcttggttgtggacaggtattacaggggctcttttgcattatttttctgaatacaaaatgcttcccacctcgggaagattgaatcagtgtatttggccatttagaatttctcatgtcaggaaaatttagtcagcaaatgatgggtgactgtcctctgggtgtaatgtagcaacatgctatgaacaaagacccttctgtaacaatagtggaaaagaactaacacccactatttctactcttcactagtaactctccctcctcccccatcttgcaacccttgtttgtaggtactcgaaaagattccattccacaagtcctactccctgaggaagagaaactcatcattgaagaaaccagaagcaacggccagaccatcatggaagaaaagtgagtagagcaggcaaaaccttgcctagtttctcttggggctggcaagaaggtctggtaggacggggagctcctggagagtctatgatgagggacaactcctccttacctgggaatgcggcctgctttgctgtgcatgcatttgggagactttagagggctgcccactaacaaatggaaagaggaaggaaaagcagcggtgacagagccctccaaggcagctccagctggcagctgcccctgcagccagctccccatccagtaagctgcttctgagcacatgggaatatcaatgccctggatgggtttaggaagtggctgggaattccagccacagaaccaatttccttgcccggagagatgccactcacatgttttgagtcagaagctgtgctttcacatttttgacatcatttaaaatcctacagcaatccggttagataaacattactctcaccactttcacagataaagaaactgaggtacaggaagttcagggaaattatgtctctgacttacctttacacagtagtgtgggtgacctaatgggggaaaatcaggttaagtaccttctggctcataaaattaacacaaagtagccaaataattcatttgtctaaacttgagtcatttctgaagtcaggcctaaatttgcataggacagcatatttcaaggtgcttggcattgtcaatgcattttacatctgatgtgtgaagtgatacagcaaaatggttaagtacttgggctcaagcaaaaaacagtgtggttcaactcccacttctgctactcattagctgtgtgacctggggcaagttgcttcacctctctgtgcctcagtttcctcatctgtaaaataaggatgacggtaatgctttcagagttgttgtgaggttaagtgaaataagtataaaggctagctcaataaataatgttagttaattcttattataacgatattcatttttacaactttgtgaggttttcagaaaatgtgctattatccccattttacatgtaaagaaactaagaccaagagaggatgagaaggaaactggttcccagagaacagaggactagtaagtggcaggatcagaaccaaaacttagatctccaaaatctttgtccagggagagacccagagaggaaaaggctgttctgcaacccagtaattaccaaaaaattacttttttgggtactgtatggttgagatattccagaaagaatgcctctgactttgtgtcatgtgcagtcagagaactgggaagggcaatgtcatagcacagatactgtagactaggcaatcttgtgatacctctcattatatgataggtgatgttcattcctgccccaaagctagagaaatcaaaaccttatgacgggaattgaaaacgtcgaactcctaaaaacagagagcagaatggtagtttctagggactgaggggaaaggggaaatggggagatgttggtcaaagggtaccaaatctcaggtatgcaggatgaataagttctggagaactaatgtacagcatgttgactacagttggccctctgcatgcgtgggctctgcatctgtggattcaaccaaccccagatcaaaaagatattcagaaaaaaatggatggttgcatctgtattgaacatgtacagatttttttcatacctagtaaagtttttctttttccgcctttgttgagggataattgacaaaggtgtacaatgtgatgtcttgatatatgtatgcactgttataccatattgttttttcctaagaaatatggtataacaaatatttgcatagcatttacattgtattaggtatgataagtaatctagatatgatttaaagtgtatgggaagatgtgcattggttatatgcaaatactatgccattttatgttaaggacttgagcatctgtggattttggtatccatgggggtccttgaaccaataccccatggataccgagggagggaagactgcatagtttacaatggagtatacttgaagtttgctaagagtgtagatttccaccacacacatacaaaaggtaactatgtgaggagatggatatgttaattagcttgattatggtaaccacttcacaatgtatacatatatcaagacatcacattgtacagctttgtcaattatccctcaacaaagctagaaaaagaaaaacttagtgacgggccctagtctcttgtgttttgttcacccaagctgggaagtgagtagaaaaggaggagggaagtatagaaaaggtgtaatgacattgcatttagctaagcatgtgtggtggtggttgttcttccatcaaagtcaagaagatggaaaccatttagagcagtaccattcccaatcagctagaaagtccactgtttttcaggatctgtatttttataaagtggcttttattgttaagtattttaacagtacctcagtgcaagccatttgtctctgaattttatctttattttctaggagccttgttgatactgtttacgccttgaaggacgaggtcagagaactgaagcaggtaataaaatataaaatcattttctcgggtaatagaaccattctctttttcttgcctcacgctgctcatgctttcagggaaggcctaggagcaaggtagcgaggggggatttttgttttccttgtgtcatcaaggtaggttttgttgattttatcatgtaagccttgaatttaaatttccgaggcttgcttgtatttctatgtagtagttcacaatagagtcccaaagttagttacaactttcctgttctctgacatccataaacagactttaagaaaagactagtcattcatgagtgtgtaagtgtaaagagaaccattcatcatggtttgtgggcttttctgccgatgtggcctagtgctccgtgatgcacactgtgccttgtgtgtgaggactgactgtatctggtgacagagtgaaggatggatgcgaggggagagagaccagggactagaagaccacttaggaggttcttacaaaactcagggtgaaacctgtcagagtcctgaactgaggcagggtaatgaggctggggaggaggaaacgaatgtaaaggatggcatactgcagagtttgaacctatggacgaggataatatgattttgagattaagaaagagccagggattaaagatgaagcttcttcccagggtgtctggttgcatatggtggtgccccttcatggagatcagtaatcacaggaggaggagaagtttggggtgttgagagagatactgagttcactttaggacctgatgagtttaaggtgcttgtgacatatctaggtggaaataccaagctgctgccaggtaatctcaggtaagtgagaggatcacttaagcccgggagtttgaggctgcagtgagccatgattacactgcactccagcctggcaatagagtgagaccccatctcttaaataaaataataataataataataataataagaagaagaagaagaagaagaaataccaggctgacagttgagattgtggacccgattctcaggagacaaggtcagtaccagagatatttgggagtccccttaatagacacttgggttgaaacagaagtgacactaagtgaaaagcaagttaaattagaagaggatcagggcagggaagaagaatccaaaaggtttcccagagacaggcaggagaatcgacaggctgctttgtcatagatgctgagggagggaaggtcgaggaaagaaagagagtcagtgatgaaagctgccccgaggatgagcaggaggagcccttggaagggcccccctctgtttgataatcaacaaatctttccccatcataggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttata

SEQ ID NO: 37267 - DNA, 84648 bp, Homo sapiens
tcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtaaatatttcttactctttgaagtcattggggaattctatttaaattgtgtactgtttgcttctgcctagaactgttcttcactttaaaattttcattgtttcggaaccgagagttatttataaattgctgaatatgcaattctgtggaatctgaaaaatagctcggggagatggatgcatttgcacagatatctgtatgagtagaaactattgcaaggtacttatgctaaatcctccacttctgcagggcttccgtggtgtcattacagaagattcctttaaatcctctctatggctaagggctatagagcatggatatgaacttggggattttttttttcttttgcaggtgcagatgttttatttttaagaccatgttcttttgcatgtgtgtatgtgtctctgtgtgtatgtgtctctgtgtgtgtaactcatcaggactttatttacaaggcatgctatatatgaagggttgtattttagatgatattaaagcttttaaatatgatctttggagctaaggtcccggaactctgcacttatgcccagagagagtgttaaagttagagtaaagtgtaatttgttcttccaaaaaagaactccttgacaactcttgctgaccttgcatatttgtataatttaaacaaatacatactgtatatggaaagcagaaactttctaagagctgcttgcccaacttttctgtttagaagaggactttcatgggcaaagtttggacttggggttctgtgttataaaactctgattttatattcagtgtcgtgaagtccctttaggtaaatctggctgctgctgtcagtgcaccgacttctcgtttccgattgctggccgtagttctagtttccattctcagcaaaattatatccttcaagacttgtgtttttttttcaatttgcaagcgcttttaagctgctgtcactggctccaccgattcaattgcctgagggctcaattcataagacgtctctgccacttagtgcagcattcagttgctgctttcaaacacttcaccactacgactttccctagtcaagtaagtggctccaggagttaaagatacacccttgtcaggcacctgattctgctgttcctgagatgccaacacatgcaggccaccttgctttcaaagaaatgacgtcactgtgcatacatactatgtgatctagcagctggagtttttgtctccttacttaggggatcataaaagaggctgtggagcgttatctctgcattaattacaagttaagaaaattgtttccaaatgcacttttcatgctgtgtatgctgaacacttcagaagtggagctcttaataagttgttacttttttctgtacttgaagcaggaagtggtttgagggagctgcgtggtctttcacatgtaattcagtgggtaaaggtgtcctgcccagaggcagagctcaccagctgattgtactctgactctcaaggtatttccaagtgagtgagtcgggggaagggagtaagggagtggactggagcttgggtcactatctgggctgctacaataggcatacaatggaaataggtggcttgactggggggaaaagattgacttaaatcccagctgtgcaatttgttcattgtttcaatggacaaaaggcagtttacccaggctcataatagcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgagtattttcttatgactgttgccctcaaattttacagggcattttcattgtggcccagacatctggaatcaattaatattccatttatctaagattaaaaaaaaaagaacttttaaaatttgggtttgtgaatgatttttgagaaagtgttttctgatttttttttctttttttctcatgtctttctgattcttcccttttttttctatcatatctttcctttctctctattgatttcttttgtgtttggcaaaataaaaggccaaggaaataatgaacatatgggaccacttgtttcacactttaaactcctaagcaagttcggtattgttttcatttgtgggaacataaaattctctggttctctgtgggtgtactggactgttccctacactaaaggaaaatgcactagaggttctgtcttgtcctagaactgtaagtactgagatttatctgacaatataactcagcaaaaaaaaaaaaaaagaaaaagagaaatctatttaaaaaaaatcttaaattcttaagttccagagacttatatgtatcgctgcacttaaatgtgttatactagaactattaaaaatatagttttgacatctaatgaagtttgaaattcactaaggctataacttgagtaatttttttccctggatttcacaaaaactgaagaacttgaaggcatctacagttgcaggtgcttagccttcagcattgctatgaacgcaacaaagaagggaggggtggagaaataggattcggtagaataacatactttctagaactggcccattcccgcagtgtgggggtatgctctgcaagatcaatcacaggtttgttcttttgaaaaatgccacgaggtccaggtgggttggatttgttgaggtttccaatggaaatattgaacaggaaaaccccactaattttacaaccaaaaaaaaaaaaaaatgagaactggatgataacatgcttcttccagtcccagtgttttgggctatgtagggggtggaagatttccatgcggagatcttgttgagaaaaatgcagtaaatgttcagttgagcttttacctcctcttctattttatgtccattatttatgatcatttgcaaatagagggcgcttttcatcttcaactgctttacaaccattaactgaatatttatattttgttaacgagagacaggggttttggttttttttttttttcctcagttgctgaggtgaaggtctgactacaaaaaatggaaatcatcattagaatgatggggaaaattttgccactgatatagagccactaaattgagagtccatggagggcaaggagggtagtcagaaaataaatgactgtttctccaaaagtgatggggttgaatggacctgccactactctgaggttcaaaaaaaatgctcttcttataattatagcttccagcatgactccacaacccttttaatagcgcccctcacctaacaccctgtcagggactcttcccatgatgctgaaagtagatgcatctgagagaagtgaagccactcaccttgagaggcttcttggaaaaagccacatctttgtgccacaagtaacaatatggaaaaacttaatgatcatcttagcatggtttctactacttagagtgaggatgaagacttgagccacaggactgctgcttttggcaaggctgccgtttggcagtctatcattgactaagtcatgccaaccaggggtcccttggtatattttgctataaaatagatacagtgacacataagtccctccaagagatgaagccataattcctgtgactaaaaataaaataaaagatttttgccagtttgagcccagtgccctatacacagaagggattctcaacacgtgttgatttgatattggacttgaggccagggactttagaatacaggagtggtttctatttgagccaatttcattcttcgattctcatatttttttctgtttctgttattttcttctatttgtggttgtgtcaactgctgatatgccccaggtaaggaatcagtctctctctctctctctctctctctctctctctcatattgaggaaacaaaacaaaaacaaaaccctgtgatgatatatagtattgtcaaaagccattttttggccatagtaaattatttttagtcaaaaatagggaatgatgttttggttaaaaatattctgctcaataatgaatgcatataccatctatggatggccaatattgagagaatttaaattaacaaaacttatttggccccaaatctgtactgagcacaatttaacctttgataattcaaaagttctaccagggtctcagagtgatatgggatcccactgtaataatagcatctttcatttccgtagtaaacgtttctagatattttgtctcaattcattgaaataggaacccataaagaaagggttcagggaggactcctccaaagatccacagtagccaggggaataaacacaggttgttggatgccgagacacgctccatccacaactccctctgggttctcatgtactctattggcttctgtgctgggtagtcctgattaatgacagtcgtggaatcgtgggagtcaatgcacttctgtcccaccccactccccttgcaaggatcaaggaggaaacctgaccctccctctgtttcttgggcaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcagtaagtagccctccctctcaatgtgctgctcaagtctaaagtgtacagctctgtggatttacaaccgcagggagtgtgtgaataactgaatgagtgcccgtatctggcagccatcctaggcctctgagattcctcaccttaaagtaagcatagtgttttggcgggactttggcaggttttgcagatctaggatggaattttcctccttaacaattcgtctttaactacttcctgctaagccttctttcaactattatgatccacctcactattccattcctttcaatgaaaggacaggacaaaataaccctgaggtattgatgtttttgttttcaaaacctatgggcgcacatataaacatatggaacacatgcagggctgctttaagtgctatgtgatttggagtaaaatagtaaggactctccagtcatgtggatctgggaaaaaaaatattaaagggcatatcctagatgtctccattcaatatgaaatcaccatgaacagacagaaggttaactccccttaaaggcaggcctgtttgcaaatacacagactgtctctaaatgcaaactgaaatgccatactgatttgccctctatgccacttgaccttgatttttttgttgttgctctcttttggcatagttcttctccgggacccatcaatgatatcaccatctggaaaagggtctctgacaagtacagaatcacttatctcttaaatagctcttaggtgattagaaagtcaacagccagtaaaaagtagacagccaagtcaaggcgtataaataatacacacaagcaaaagtcaatgattcctgtgggaactgatcacttaaagaatctagctcccatgcatctatctcactgtatattataggacagagaaagatttaaagccagatgcttgttccttataattctttggagttttagagagttccaggaaactgagcatgagtcattcttaaaggttcatatcactccagtgtagacagcttacctcagttacccactatgctttgaatagctcctgtgatgactcacacacttgaagtctctctcatccttcccaaatgtcagcctctctctaggcaggtggggtatgtgtgtgtatgactggcagggtagagggtggcctgtgtataccagtctggagatcagtaagggagatgggaagaaagaggcttgtgagggtattggcgatcagtacttacagtggatttggcaacaaatagtttttaaatcactagtgacaaagaatcagaagtgccttctactatttgaataggcaaattcccactatttgcttccagccagtcctttaattgaacgaactcatttatttttctggcaataaagcaattctatccagttctctgttgcagagcagatgaatgagtgcattgggtgagtgattttccaatagcagacttgttttacctttaaaatatcctgtggaagataactgtgggacatcacatgatccaacagtgggtcataattattctataatttgcagctactgatcctcattttttaaagaaatgaaaaagtggttctcacttattatgcccaaggggactttttttttccttgataatccatttgtgcaatttcctttgatccagttcactaggtaattgccaagcctagaagtgtcctctgttacgtgccaggttgaattgtgatgttcaacacgacattgctccagaatttccatgcacagtgcatgaaaactggatctttctatgcctatgatgtttgcattaaatgatgaaaaattagaatggaaaaaatgattgttcctaagtaactgtatgatacttataagtgtttgcacagacacttaaggatattggacaactaaaatggaaaccaatttccaggttctcttattctgttactgcaacaatcaaatttcagcaaatttttaaaaattgtatctcaataacttgaaaaggaaatgttatatatagcaaatcttgattcttactatatgactttagctagaaagtggctttgtaaatcatatgttcttgtcagtattgtcattgaaaatatgtgtgtcatgagttttgccttatagaattccatgacttatgttaatccgacataccctcatgcacagaagtgtccaacataccttcatgcccaaaagtattcttgctaactttctagtcaactggacaatcttatttgcccaaaagaaattagtccatttagattattttcatgtaattcaaaacattgatggagcatctgttatgtgtaagcattgaatgagatatgaatgagatgcctagaaatgaatgagagattgaccttgttttcaaggggcttacagttgagtggtaaaagaaaaatgcaactaagtattattgtcataagagaaaaataaccatggagaataaattatatcctttatgtttttcttgaatattttggtctaccctgccaagaataataccctgtcaatgggcttcttgatgccaaaggacatatttatttacatttgaatccaagtgtctagctcatagcctggatgctatagtagctgcccatatttgattgttgaactgacaggattgaattgaattgaattgagtctagttgaatccaatcgaatagaatggaattacttgtttgggatcttggtcttaagaaccatcaagaattaaggttgtcaagtactgtggacaatacttctcacctcatggttatctagttatttaataaaactgcttttatttttttttgaactgaaaaaatatatactaacaatgacttagaggctgctgcattttggtcatccccaggctacattgatgtctgttttgtgtctgagccaattattcctacaggcatcaattgttgtcaacaaatttcattcagtttccttttcatccgctgagatttactgtgtgtggagaagtcagctctaagcacatagtctttgaaatactttttagagggaagcattcttccccacctctatacactgtcagttgactcctattattctctttacacttattttcaaagttttattgtggctgtgacttttattttaaactgcttcaaatccattttggaagtacaatttttttagtagtagaaggcagtttctgattttagtttgaaattcaaacatctaaaagaaaattgcctccatatctatcatttttgtcaatctgcaatatttaacaaggagagtttttttttaactctattagaactgttctgaataaaatattttgtaatgcttactgtgtgtagattgacccaatgatgtgaattgagctcatattccccttcaagcccaagttccactacagcaagtgaaagcaaccttctagattatctgtttgtgaacattatcccatcataaatggaacagttcatgtataattaatgcagcttccctagacattttatgaaatgaaagacccaatgaagagctaattactcattctttcctatgcatcatagggaagataggagagcctatcagccagccttgtgttcttgcagtcctgtgagaaaaatggtggcataatggagatgaaagcacattgggaaggagctagcgattttcttactagattgatggagcccttataaagggtggctcattacaacctcattttgcatgaaaaacaccaagagaaaaagagcttcaaatgaaataggagaagtgaagcttaccatagatataatttttgacagccatggtgattaaccattttaacatgctgctatgggcctgtggaatttctctccttggagattcttaaaaaattgacagacaaccaaccatcttggatggtttcaattaagagcaactgaaagaaagagagtttctggggtctttttaagttttaagagtctataaacagtcccttaaataaactgtatatgctttaccttggcggtctggggaaatggagaagtaaatcaattagaaaagccaagttggatattctttcagctcttcaggatttatagcttttgtaaaacatacttccaatgtatagttattaagaacaggtctgaataaacgaatggcattcttcatgggttaaaacagactgttttgtaagagctttaagtgaaactttacaatgaactttcattgttattgattgcaacaaccttcttagatctaggttattattattaagtcaagcttctttcctttgatatatactgcccagaaaactactcccagacctgtcgttcattagttgtaggagtttggcaggcatttaaacttcctgggtctaaacgtccttgtccatagaacaagggaattttattaaaataaatgacctcttctagctttaacagactcatagtctaggttgtatttaacaaagctctggtgctattcaagaaagaacaaccttggatttaagtagtgaccaaataacatttagtctcttttatcttatttacatagtttctgttggtccccagagataggagattccacccagttaaagtaagaggagccagattcttcgttttgttttgctttaagctggatttcaacccctcggggatggaatagaagcttagatatgaccaaatacatgcaggtcttttggactaaggagccaaagaagcacacgcttcatgaaaacagactgtcatttttctttgttaggatagacccactgacagttctcatctttacattctctcactctcctgactgtgaggtcaagtgagtatgtacatttttagatgccctttattaaattagaggggacaaataagaatctacaggtttctaaaccttcaccaaaagcctcttcccagcctattaccttttcaattaaagaagagagtgtataattggtgaatttgacatcacactcacccaccattagcattgttttgagtggggctggatttgagttgcatcattttcattccttttattggtaccccttagactgcctgctatgcatctgtgtgacagctggtcaaagttaggggtacagtcactagctgtgggaaagcttttctctttgaaactaattggtacatgtggggtttgaccttatgaccctggcctcattagtaccactaagctaataggctacagatattattaaagagaagcaatgtgtttttatattgaccccaaatgcttgttcctgtctttaaatagtaaaggaccagtttctgcaaccataggaccactaagaaaatgatgcaaaattagaaaataatttgcatttttttctgacatgctaatgcccttcaagaccatctccctcctgatggagagttataaacaggagagcgaagggttcaagaccaagggcatggcctctattgccaaacacttcaggtttgaaccccagctctgcaacttacttggtgagtgatcttgagcaagttatttaacctgtttgttcctcaattttctcatctgtaaaatggggcctgccttatagagttggtgttaggattaaattagttattatattggaatatgttaacttagaatattgcctggcacacagtaagcaccacatatgtgagctattacacttaattattctcttctgagatcaattgcagaatctattgccaatgctgaggtatatgaacggcccaattaattacacactcattttctctccttggcggcagctgattaaaaacctattatgagtagtaagaattatgtagtagtattagtaataatcacatgaagaatgttatgtttatctagtatatttactttttcaaaatccagttgtatcagctctctcactttgtcttgactccacttttggtgggcaaagattattgcttcatgggacaaatgagaaatgtgagacatgaacattttgtaacttaccccactgaatggttccagaaacaaagctaggttctcttgcctccaagaagtgtgtagcatagggagatgcttccaaaatcccagtagtcttctgggagataaggagcaagaatcccagggtgactaaattgattttgaacactttcttgaaaagaggcatgagagagatatctatgtaatgaccctatattttagcttctggaaaaattgaggaaattctaagaaaacttcctcaggatgcacaagaaaagtcttcttttagaagaggctaattagaggctgctgctgtacaagacccttcacagactgaattcagacagaacactgcaactcacctgtatacaccaggatatgcagtaggatctggggagcttctcttctgcccaacttcaaatcttcttcctcttcctgcaaacctcaagtgcttcattacttgcaactatttgtttaattggtctttctcaaagacctactaaaaaaatgctgtttaattggaccaaactttttcttggggtgctattagagtcgtagtaatgggaggtggtcacagacaccataatccaggcaggaagaaacttccccaaaataaaggagatgtgggagcagccagtggttgggatgcaagaccgccacctttgctggtattactcaacgagctgtttgaagaccattggtattgaaatgtatcctatctccagtggctggtaggggagacattttggatccaggagagaattttggcattctgctaattcaatgggcctccaatactttgaccagacatcttgtgtcgtgccatcattgcccaagatctccattagagctgacttcatctcttcagcagccttccttctggttttacagcccacaccacagattcagacacagtgaaaatagccacaaggtctctcccaaggagatgtctcattgttctcgataacagcctgcaagggctttgctcttttgtgcagccagacatctttgacaacccatggtggcaaaaaatcgttttcgcattgagctgccgccctggcagagttccatcgtacacctctccatgagacatcccaaagaattactttaggttgcctggaaagttcaaacccccaggccttattagctgttagactaaggagatgacaacacaacattttgtttgtctttatctatacatgagatcatgtttaaaacatagcaaagaggtgttatttgacaagcaattccctaactgcagtaagttgtatgcctatttaatgcattgtttagtctcacattggctaaagccacttaaagaagcacttggcaagctctagcttttcattcttggcatagctgcccctcttactttttcactgaaccttaaataccaagaaaaacccttcacttactttacatctggcatattgctttctgcaactggccagaacctttgcatgtggccctctgcatttgtcctaaggtaattaatggctttgcaatatttgatcatcagcagcacagacacaaagagaaattgtgcaaccagcagagaccaaacagcctcttttaaattaaaatcttttgcattaaatgctcaggcattctgcaggaataaagatttccatgccaaaaaaaagaggggtcaaaaagaggggaggaaatacccaagaacctgattattgattaagtatacatctctgtaatctctccctcttaaaactacccgattgttcaaagaaaataaaattgaagattgctacaaacttagaagtccttgaaaaataaacttgtcaatattatgcaatctagtcatgtatcaaaactgcacttttaccccatacattcatgtacatgaaaatgataataataagaattagccaaatgctgactgaaatccagagagaagtgacatgtgcaaagtcacacagctaattagtgacaaagggagaagatactgtgattctcttttctcatcccactgcagtattcctccatttagcaacaattagccatgtctgtgtcaaagttacctggtaaattaaaatgaccaagagaagccaccaatcaaattcatccaaatgagcatagatcttgttggttccttcctttcaataaattcacctgagacttaggttaacacttttgctccctcgctgtggaaatttgtacaaactaaagtgattccctgcctgtctcctatatggtgtgcaaagccttcacatgtactttgggcattccgtccacttaaggtcataatttgactattattgtatattatactattctgactctatggtcactctctccaatgtcaactttggtagaaatgctttggaatgacttagcaaagctgcgctcctggaaaatctgaaacagtctgacgagttgttggatcagctttttttttctggagatttctctgactgtcccaaaccaaaagaaatttacacctgatttttttgcagactcccaagcaaatactctatgaatctcttctggttttcttctttcatctctggtctttatgaggtactaaaaggctctttgagggacccttttaaactttgaaaatttgtcagacatagaagcaatccggagagtattgctgggaagatggtactacctctgtgccatttaccctgatgaaatgggtctttcatcagaggcaagtgatttagaaagtctgcactgagccaacccacatgcagccaactcctgattacctgtaaaactggggaaaggagcaccaagacttagaattctggattaaatggatttaaggacactatagatttttcttctccctccttgctgaacctatccccaacctctttatgagaccaagtgatgtgggttttttcattttggtttttgtttttttgagacagggtctcagtccattgctcaggctagagtgcagtggtgtgaacaaagctcactgcagcctcaacctcccaggctcaagtgatcctcctaccacctcagcctccccagtagctgggaccataggcgcatgccaccacagctggctaacttttgtatttttttgtagagatggggttttaccatgttgcccatgctggtctcaaattcctgggctcaagtgatctgcccgcctcagtctcccaaagtgctggatttacagtcatgagccactatgcccagactgttttaaaatcttaccttattctcatactcctcagtcaactttccccaagcgccattggcaacagagtttttcagcctcaacactattgacattttgggtcagactattttttgctgggagagggagctgccctgtgcattatacgataactagtaacatacttggcctctatccactaggtgccagcagtcccttcctcccagtcacgaccatcaagaatgtttgcagacattgccaaatgtacccctgggggcaaaatcacccccgagtcgagattcctagactagacaagtctccagaagagaggcaattagagagattggaaaaccatgagtgaaagtaacacatcaattctcagtcactgtttaatccagagcctatggtccattgcctggagcaagccatgagaagagtcattgtggttttgaaagcttttctctgaaaaataaaagttcttcctataggctatttaaaaccttttgcaggccttttctttcttgccttatagccatggaattcatgtattttagtaagagaaggaagggcaggcagaaatggttcagagtagaaccctgtgcttagaagtttgattgagaccacctggagcaaattaaaaagaagttggttatctttatttatttatttatttatttatttatttatttatttatttatttatttgaaacagagtcttgctctgttgcccaggctggagtacagtggtgcaatctcggctcactgcaacctctgtctcctaggttcaagcaattctcccgcctcagcctcccgagtagctgggatgacaggcatgcaccaccttgcccggctaatgtttgtatttttagtagagacggggtttcaccatgttggcctggttggtctcgaactcctgacctcaggtgatccgcctgccttggactcacaaagtgctgggattacaggcgtgagccaccgcacccagccagttgtctttgaccttaacatatgtggctgttcccttgtcaggcacataataaataaactcaattcctcacaagtgaaaaagcctggttcaaaggtaatgaccaaatttttctccttttttcttgtgcctttcctatctgagtcctatcacagtcattcaattgctcagaaacagtcagaagttccccatttgggcctgacccagctcccctactgaacagttctatgaccttggagaagtcacttaacgtccttgagccttacatagcttatcgtaaaatgggaataaaaatacacttctgagttgttctgaggctcagctgtagaagtgctttggaaacgaagggccatccaaatagtcacaactgatgaactgaattggatgctttttgccttgtatcccaaatcatggctcacaaattagatcaatgccatgatttctgtaaaaccttaggcaacaattataatctggaaaagttaatttggcagtgtatcttctcaacctcattaattaaaaaagaaaagcatgttgctgcctcctgttcacatatcactttacattgagaccacccaagagttaattaatgtatcttcagaatgctcactcagtatcactatttcctctcattggaagaagcagcaaagagatggggcctatcattttaccacactgagcttgcttaaagactttgttccccacgaggtgattgggtagtcactgagagatatcacatataggcaaaagatttctattctctcaagtcagctattggtgatttctgcttagcctcaaaaagcagcattcagcagaggaaatgtactcactaatcagaaaaagtatcttcgcactctcaagttgtacatccaaactgttttcttatcacagcctgacttaggggaattaaatttttttgtttgagaatggctttgatgaaatcaaaattgtgagttttatcaccatatggaccagtgaccctgtggttcttctatcccaggggcctcacatcccatggctcccagagacacaacatttgatgcagttgtaacacttttgaaccacacaatcaaatactggctactgctactgctgctactgtaaattttcattctctctattttatcttgagctttttcagaagaacacagactaagttttaagggttttcccccctcctgtttttcacagcatctagtatggagcacttaataaaatttcttgatttgatattgaaaatgtcattccaaaagctatttccttcttccagtccccagaatatataccatgacttacaatttgctactgacatcattttggatctgagattgaagatataggagaaaaaagtcaacaagtctacttgagatgtcacctcttaggaccccttcaccactgctccactgaaaatgcctagctcaagattaagctaactctagtcaacaggtaattttcaaaggctactggaccctcaccaataaggtctacttatgaaagtgagaacagaacctccactcagttcctctctacttctatgtgagttatttaaaaggagtagtgttgggcaagggaaggtatgcaacaactggtacatccctggctaaggtatgaatcacagctggagcaccagcccttagagaacactacaagtggtttctatttgccaatgcagaattgaaaaattagagagctagaaagaaccatatagagcaatctgatccagtgctctcacttcccagatgaaaggaccaaggtccagaaaaaacatgatgtgcatgaggtcacaaaagttggtcggaaaagctggagctactggtcggaaagccaaggctacatttcagtcacctcatgcttggtccagagctctttgcacagctggaccctttaaacttaacctcaataaactcatatgagggtagtgctcataaccacagtccatacactcaaagtgaactgctatgtcatattcttctggtgtaacacctcagaatagtttctagaaaattaagctcttagccattcatgaaatcttcatttactaatttctaccatccatcggataacatcatgaagtctctttatcccaaatctgatcgacctgactgtaggactgtgtaccttaataaaccctagtagtttgagggattggaggcttacaaaagaaataaaggaaaaagctgattttaatttgaagtcaagccagcatgttgcattgctctctaactcagaagtgaccccaaacaaaaggaattatcgatgtgttgtctgtcttcacacattcctaacttgctagtcttccacgaagatcttccatgaagaagcttaaattttcctacgtagtttgagttttatgtttctttccattaaagtttccagccgttcatagacatatttagtttggcagaaggtagtggtgactcacggaatgaagaaatttgaaggcaaagctactgaaaatggatctaatttctttttggggtaatttgggagcgagcaattgataatttgtctaattttcctggtttcatcagctgccacactgccaaatatatgttccatatggatgctttgttattcctgaaacatataacaaatttcagctgcgactttatctaatatggtcaaagggtaagactattgttggctcattttctcattgtttttggctggacaccctcaatcaatggctattgagtgaaaaaacaggatcatattgaaaccattttcagcatgttgcttcctatggatccaaccatttcactgtgagtttgtcaagcacagcaaatgttctctattaaagggatgactgtgttctcaacatggatgcgactgccagttaattgcattcaccttataattccagtctctcaatttggtgtagagatggttttggctctccaaagattccttcttttctgctgattcttacctcctagtatggaacagatatttgaggatgaattttgagaagatcaatgacacacatacaataagcatcatttcaggcttcccttaagttagacagtctgtgggccctgagtcatatgaatcataagacttgtgaaaggtattagtgccacaaatctggctggcatttctgtagattatcggtgctttgcatgcaattatgaaaatctctcttaccagataagtcagatgggggttcagtaacattgcacaaaagcatcatgatgtgtaagctaaagacaaagaaaggcttacttctggctggttctgaagtagacactggccacttagtgttttaaagtcattcagtggatgattggtttcaatgaatataaatgattttgatctccctccccaacacacatatcaaaaacaacagtaataataaagaacagaaaagtctatctcttagaaaaaccagatttgaaaactggctagggaaagtgttttgtggcaagaaacaatctcttgtatctcttgtttacaacgggctaattggtttgattaacaaattgtctaaggggaatgtatcaatgttgcttaggaaaaacaaagcttagtgtgtgaaaatacacatagacatagagtcttgctactcaaagaaacctgagggctttttagaaatgcagagtcaggggccctgaccccaaaccaattaaatcaaaatctgcattttaacccgatacccacaggatttggatgcgtgttaaggtttgagaagccccatctagagaatggcaggaagtaagaggtacttgctaattcgtggctcacatttgataagacagagtacaaaaagatcaactgtcactgcagatttcaaaaatgatgttaaggtcaaacctgcttgtggccattaacaatatatatgctgattcactggtatttggtccagattccctcaagttggtggaacctttcctcagaggaatgatagaactgctccaaggataaccccatggcctgaccttctgtgaactggaaattggaacttctaattgctgtagctgcaatttccaagcccatcactggggccaggaactgagccccagtccttaagatcttgccagtttctttttcaatagttacatttttcaagaacagccaagcaagagtgcttcaaaaaaagaaaaaaatctaattgcattaagtggacgaatgtgtgttttactcatatcaaatttcatcttttgttatgctcagccagattctaatattatttcttatgggtctgagttaattagttctatgagggttcccactgggattttagagaaatggttttaaggtaagaaaagtctattttggtcacctatcagaaggtgaagggtaaactttaaaactgcttttcaaagagatacagctggcttcgggtctttacgagggtcattctgaaactcaagttccccagcctgagcccattaatgaaggtcattaatgaaggccttgatatctgaagggtgtgcttcttcaaagggacattgtcccacagcagggcaggtaaagtgagagaggaccagtttttaacttgtatttcttgaaatgacaataaaaagaaaggggggcctttggattggagacttagaaaatcttggatttactcagaactctaccactaaataacttggtagatttgattattaatcccctgggtctcaaaacctgttgccattgaaacaatgatacgtaaatgaaccaagacattccacctttgaaatgtgataattgtgatctctcttcccagtttggcagggaaaaaaagtcactaatatagttttcacattgttttcacacatcttttacttgaactttaagaacatgccacttcttgtctatattcttgacaaggataagatagtattggacttagaccaaaactatatatttgatttgtttagatttaatgcatattattttaatacagtgatatccctgactcattggcactctacccattgaattaatgttgacaagataatctctaataccttttccagaatgtttactgctgttcatgaaaatctctaaaatcccttaagaaatctgacggatatggagattattgtttgtttctttgttagtattctctcattccttttgctgggtgctttagtaaaatgtatggaagtaaaattatagctctgcccaatttaattgtagaatcatcagctgggcacctgctctgtgtttagcaatacccaagggagaatgatgccatcccttcaaagaggtttctttgtggggggacccatgaaattccaatcatacaactgcaggcttgagtcagatgggaatagttctcccctatggtatcccagtccacaccatctattgagtgtcttctggttagccaaaactaatgatgaaagaaatgagtaaagcacagctctatgcacatggaattgatattctagagcaatgtcacaaaacgtttccactcccaccccacctgcatctagtccacagacatgttttgtttggtccacccaatatgtatttgttttaattttggaaatataaaaatcaagagattataagcaaaaacaaaagattaacaacttctcttatgaaaaaaatggtgcaatccagcatggctgagcctgcattcttgagtggcagtttttggtcacccttttatgtgaagtgtgtgcccttgcaggcttaatttattcattatatacctatctggctcagcatacattgacctatgccactcctgctccaaatatgcaagatctcgttggatattaactatacgcttgtctattttattacgttcaagacatatctattgcctttgttctatcacatagttaccagactaactgctgctggtttatataaataagacacaaacctcatctttatagaactgtatagccctccccaaacagagcaagggtacagctgagctagaatttaaaagacaatcaagtcattctggtgaaggaagaaggcagattttaaaaactgaacattcaaaaatttagacatcatcaaagggatatttcctcaagagcaagtggagtttttagccggtgaccttgtaaagcaggaaaggccaggttcccagccaatgcaatggatgggttgcacaatcaccctaagtgttgagcacagtggagaccatcaacccaactcttcagacaaaacaagctgtagccttacagtttgttttgcaccgagatccataacagctgttacctatttactggaagatccttccagtcccatcactatttagatcctcctcatcgcccaccaaaactattgcaacagcctcctccatgatcgtgctatgtgcaagactgcttgaggccagccgtcccacccatgagattaatctttccaaagcaattcttatcactttatcccttttctaaacaacatccagggaccattcatggctatgtaaattgagtgagtccaaactccccaatttgacagtaaggcattttacgtaaggtctctatctgactttcttaatgtatccctacagcagagctcacaaactggcaatctgtaagttgtatccagtcctcataagtgtttttgtgtagtgaatacagtgtttttactaaaatttgaattatctgtcagtatttactaaatgactctccacttcatattggcacatgctttctgctttaccaaaaaccccccaccactctctattgccttgctctggtctacttcacttgcctgcatgacttgctgtagtcattgagacattgacttgattgactcaccaagtttacaaatgaccccctacatattccaacatccgacctatgtgacttattaccacctattttattttcctggactttcctctcttcttctctcaaatgtcacctcctctgtaaaatcttctaccagatgtcaaccctctttcctctgagagagagaagcaataatattactcttacagcactttgtttttggtttttttttttttttttggtcagtgttcctaccatctgcttaactataagctctgcaaaggtgagggctatgttttattaatctctgtaagttcccacttactccctcatacactgcactatccatgtctgcatggaattaattgttattcgtttttatgtggccttacaggcctagattagttatgtgtgcctttaggaaggcagtaactcatttgaaatgtagacatggctgagtcggaaggcctccatggacttttcggtattttcaagtacagagtgagaagtgctgtatctaaaggaaactactaagggaatttaggtaaacagaacatgatcctttttgttggaagctggctgtgatctccagattaaaacactattgcatgcctcatgaggagcatcagcaaatcctttagtatgcacaacttgtgttagaattgcaggagtcagtctattcctgggggctgggctgagataatgaattgagtcaatgccaggtagagcacaaatacgctagaaaaaatgaaacagaaagaactccgtatgctgcattcaaaagtgtcaatttctaaagtttctgaataactagaaaggggctcgcattcctgtttgccctgcagaaggattgtcaacaagttacaagattatagaatcaaatctcaggcaccagaaatggatccaacttagtgaattttgactggaatgaccagttgcaaaatattgaccaagaagaagaaagtcattatttttcaatgtcattaaattcagcaatgttttatggataactgtgtacctagaattgtgctagaaaccaaggggaagctgaaacgaaaaagccagagcagaaaactaacgttcatgaacacccatcatgctcccaaaaagtaacatacaaatctgccttaaggttaccttcaatctggttaagaaaacaattcttacccatatgtcagaataatcatcataaacctatagaattaaagtaagtaataatgtataaaaataacatttttttctcttattcttcctggatatggcagatctcaaaatatgtttactgaatttccaaaagaatacaaaaaattttcatccttctctctatatatacagtcttgtgaaatcgtccactaaagtttaaaagtaggtggaatttacaccttcatgtactctctgtctgcctgggtccttggctaggtagaggcatggttgtgttctatagactgagagaggccagaaatactgggcaaacaagccgctttgactttgagttgatgaaaagcttaggaaaaaatccctccttttgtagagctgccaggccagtctttccaactcaagttcaatgatgcgtcaaaattctacctggagtcatgaggttcccctcccatcttatcctctgtatcccccggtccagataggatttgatgcagataacatgggcactgttggttgcttttcttttagcatgaggattcctcaaaacagagttttgttaataaattaagcagaatttgagtgaatttaagcagagtttgagaatttaagtgaatgtctgggtatatttgaataatatttattttgctatcagcatgacaacattggatatcaaaaagagttctgaatatgaggtgaggagacctggacaccctgaaaagccttgaattcgctggttggctgggttctgtcaggcaattctctcccttgtcaaatgggtacagtcagccctgcctgcctacccaaagcagtttttttagtaccaggagagataatacctgtggaattgccacaaaattcttagaaaatcaggacccgctaccagtttccagaggtaatttgagtgaagtgttgttagaattgagggagggctaggctagagtacatcctgaagttgaaagtgggttagccaagatgcattcatgccccttcctttggaacgtggggactgtcattcctttttgggtcatgtatgatttctgtggactggaattacaagggcaaatgtaggaattgctgtaatattggtcagtacttttcacattccgccatcccatgagtagggataagaggttaattaaatacatctctcgggcagcagaaatgatcaaggctgtccctggaacacagttgcttcaaaaagtaggcttttgtttcagggaagatctcccacagagaagcatggaacgccaaagagaactataaataggactatcatttatgtcaattataaatagatttgttcccttttgattagaagattaatgctagctgaaactctgtagttgagcagaaatgagggaaaaacttctgacaaaatattattacatgctaacagttagatttgataccttttcctccctgaagtattttctctgattttccctaaatgaagactttcttctcgtttgaatttatgtccagtttagtctttgaagtgcgtttgttcatacttcttagctcctcaggatctctagattagacaatacacacacacacacacacacacacacacacacacacacacacacaccttttttaaatggaaaaaattgaataagttgaatgtccgtgttaggaatttaaaagggggcaaaactttctcctcagatgctcctaagatggccactacgccctcctccaaaattctgctttctgtgagggagatgttttaccaaattaccatgtacatatggttccttagcaacccatattaacactgagcataatgaccaaagagataaaggaaaagatcagtagaggaagggccataagccatcgctgctgagcacctgcctgatatggagccatattttttcattctccaggaagcgatatccaatgggatcccaactctttacatatggttaaccaacttcttgtccttgattgtgttcatgacttgtctcttcccagggccagagagagaaatggcaacttcccatccaagctgactgccaggttcaacctgggaggagagattgcagggtgcctcagtcctctactggacatactagaatgctggtctcttccctgctaggatgacaggatggggaattttgcctgagtctgcccaacttgcctcatggaggcttttgatttcagctactgcaaactaagcattaaggaaaggggtgcaggtagagactggaagagagggtagatgcaatgagtggagacctctgtgtggaactcctcccccacttgaaatgccctattctggtttcgctgtgagatatttcaaaatgaacttaacttgtcaactgaaaatgtactgcctgacctgagatttctggaaaaacatgaatcagaggtttggaaagtctgggttctaactcataaagaaatatattgaatatttataaagatataacattcttagaactgtttctgtgtgtgacctctctcttccaagtggcattgctcaacagcccagctctcatcagaaggctgacattatgctgttgtgcaacttgcagccatagcaatgtcactttgttaactgcacttgctgtgcattcaactattgagaagccaaacagctttaagtttgagtcagaagttctaggcaggatcattcttgtgaaacctgaacccttagttcttctaaaaagtcaaaatacatttggatcttgcaaatcgagaatgtcagagccaatattttcctctttaatcaaaacccaggaatggcacggtgggtggctggggccatgtcctcccttcttccctttcccttcccccacacttccagccaagattctccaggcttgagagagctgatgtggaaaagcagctctggcccttgtgtgttcagccctgaacctctctgccaagcaccacattaatggtggacactaacgcattgtgatatagaggcatgagcctgaaatcaccaatttgtccccagactgataggtaaacagcaaataggaaagccttcttcttccctctcatccctgcattcccaaatatttggggctctatccaacagcctggatctgcagcaaacatttgcctctgactcaattgaccccttcatggcgaatcttacatccacattggataactctactggctcaatctatgaacaattttcaaaattgaggaaataaggcccttttccattcttaaataggctggcctaaatattcttgggagcttcatggagagtgtcatgccctggcttattcgcaaaggtggcaatggccttcagactcagctaagacaaacattggcacatgcaggtggccatcagatgttaatgtttatcttgttcctctgtattgctgttatctttcagggaaatctaggaatagcagaaagatgaatctttccttccccatggggcatgtacttccttctagggagtaggaagagaaaaccctctcattccctagacctcatgagttactctggagggttggtagtagccatggttaatggcaagcttcagaagggaagagcttccaaaaccttgccatgatgcctgtgaagtgctgtgagagtactcatgtttctctggaagtcacatcatgtgtttaaggtaggccttgtacagggaggattttgatagatggaaaaattctggacacagaaactaactcaatagaagagcacatagacagcaaagtaaggagtatgtttgcaggtgcatgagacatccagccagttgtttgggtgttaggctagtgcagagcagtgcaagataagcccagaaagataggttggcacatctatattgaagaattataatagctagcactttccaagctcttatatgcatgacactgttttaagcacttacatgtattaactcactgaatcaccaaacaactctgtgaaataggtactatcattatcttcactttacaagtgaggacactgagacacagagaagtacagaatgtgattaaaggcacatagattctaagtgcaacgaatccagggttttaactcaggcagcctactcaagcacgcatggtacctgacaaccttgacagcatgctctatagagcatacatttattctttgcttcttcttccatccccacatccctagccatggaaatgctgagtaacttttaaggccaaactcatctctttcctagcaatgcctcttccaacttcatcataagagaaacttatctttccctgttagaggcctctctttttttgtacatacagtaattttcccaaccttacttatattagagttaagaatgtgttcatctgtgaacttcttcagacaagaattggcatcatattcctctgtatgtcctcagaatctgggacagtgatttgcatgtagaaagtgctcaattaacattgcctgagtataattgaataccggaggccactaactgaggcctgaagaaaagtttcctaatcctaccatacctctttaagatcatctttccaaattcaaaacaaagcaaaacaaacaaacaaatgccaagctctatagggaactctcccactcctgaaaacctacatcctataaaaaacactttggaaaagcacaatgtagaccctcctaggccacacacctaacacattattccagctttagccttgcttgactgtaaaagaatgctaatggcagcagtgcttctaaaggcaaaagcacagccacacatgaatgatgtatctcactaagaactgtggggttccaggatttctgagaagactcctttcattctgataaagttctcagcttctcgacccccaaatcctaactccctgaggaagattcaaaaacacccaatttaattaaagcctttttttttctcatattgaagtcacaagttttcacagggtgcaacgtgttgctaacccagcaatttccagacaaggctgctcagcaaagcaggtgctgttttctttttagggcccatgtccttaaattgctttgctgctcagatgtctcaaaggtccaagtttctctggcagattccagcccaagcgctcctctttgacccagctctttctggctcagaagacttctttttcccataggtgcagttagccaataagaagagaatgtcttatctttttaaaaagtacacttccaatgtcttcattagttatcttcaaactcagagggtcaataatcacagcaagaggagcaccatgccttctggaaggatgtcaaataagcatgctgaatggcctacagttttgtaattggcaagacccccctaacacagattgagtgttacagatctgcaaagttcagtgctaaaatatgattgattagtgtgcaaatatttactgagcatctattttatgacaggctctataacagatgctagggatatgacatttgtatgagtccattctcacactgctataaagaactgtccaagactgggtaatttataaagaaaagaggtttaattgactcacagttccacatggcagcagaggcctcaggaaacttatcatggcagaagaagtagacatatctttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtcttgatcttctaacctcgtgatccgcccgcctcggcctcccaaagtgctgggattacaggcgtgagccaccgcgcccggccgaagtagacatatcttacatggtggcaggtgagagagtgtgaagagggaagagccccttctaaaaccattagatcgcatgagaactcactcaccatcatgagaacagcatgggggaaaccacccccatgctccaatcacctcccaccaggtccctccctccacacatgggaattacagttcaagatgagatttgggtggggacacagccaaaccctgtcaacactgaaccaaactgacagggttcctgcctcagatgcttagaggttagccagaaaggtgaacatggccagtgccaaacaatagcaaggaagggagagatccctgtgcactggaatcatctgagcggtgagctatacagtatattcctcaagttttctttccttcccaatggttggaatatctttctcatcgatctcccatcttcttttcactttctcttcttttcatcatctacagcatgcattgttacacacccactgttacaaaaactggtattagatttgttgtggcaagaaagcctcactgtccacaggcctacatcttagcaccttgatcttgagcttctagaagttctggcttcctggaagttcattacttactctgcgtaaacaaatgaaatagagagcaataaaatgcgctcagtaattctcacattatttgtttgagatatactgaaattatctacagaaaggagagcaatactctcttatccttgaagatcaaatgcatcaaagagttacaggttttgataaaaacttcattgatgaacttaattcctatccaggagtcaattggtctacgtagaagagtcctaagaatagaaaagctacactaggtgtgcagaaccattcttgaaattctgtatatgaaactgtgactcacttgatataactttagagtgtatgttttgacacctgcttattttcttaccagtagcctttctggttttccaaaatctttctccttgttatccactgacaccatcagactaacctactataacaggttaacagactaagcaactataactaatctactataaagatcttttaaagcttcttcaaggctgaacctctgtgactctgcattcctagatcccaaatcctatcttcaattaacagaggtttaggagaaatgacccaagatccttcctctgaaaacccgcccaaagtattattgaaatcttattcaaattggaaagaatgatttaaaactagagacagagatggaagtatattattgtattgacaaacagcatgtagatattgagaaaatgaaattaaatgtagcaagagaacttatttaagtctcccaaatgagtttgaaagaaaggcaaatgtgccctgtatctgtatttgccaacacagaaagagtaataataatcatctccagattagatgatgaaggccttagccttcagatggaaggcgaagaagagattgaaaaatctggaaatgcagcattttatcaagtcgaatttagtcccagagcaattgggcatccatttgtctccaagtggagcagtgtacgatggctgtttccattcgtggcagagagctgctggggccatcggagcaagagatgcttcacaaagaaagtggaaagcagcgccaaaaggcaaatacaattcctgtcacatccaaaatagttcatttagctctttatgctactctcttactctttgtcatggagcaatttctaggagagtcgcataaaagtagggagatttttagctttgagcagcaaataagtgaactgggcaaggagagcatgaaatttagtgaggaaaaagaaaaagaatgacaggggaataatataaaaaccctgggaagaaagcacttcccctgtagaaaatctactatatgaaaagtcactcctctaaaacagatatactcaggatggattttctccattcggaagagtccatcactttaataaaacacttttgaagtcttcatctcgtaacctcacgtttaacatgtctgagcacttcttgagaactcgccctctctctatgctactggatgagacgaaaggagaatccgtgagcccggtgttctttggaggcctctctacctacgcacatttgtgcttcacttctgccaagtgaatataatatgacaaggcttagaaagcccaggtgatccagagggcaagagtttgtgtcaagaatagaggtagaagaaccatcgaattatagggctgtaaaagaccttgaattcataaaatccctccacagagaaggggttaggattcaaccctagaggaatgtcagcacaggcctctctcaggatgtcccttctctgacatcctgagagaggcctgtgctgacattcctctagttggggggcgggatggggaacaaataactttactgccttcctgttctgcaaacagaaaaccgtagcaatggggtatcataccaatttttcattattattatactttaagttctgggaaacgtgcagaatgtgcaggtttcttacatagctatacatgtgccattgtggtttactgcacccatcaagccgtcacctacattaggtatttctcttaatgctatcccttcccttgcccccaccccccgactggccccactgtgtgatgttcccctccctgtgtccatgtgttctcattgttcaactcacacttatgagtgagaaaatgtggtgtttggttttccgttcctgtgttagtttgctgagaatggttttcagcttcatccatgtcccttcaaggaacacgaattcatcccttttcatggctgcatagtattctatggtgtatatgtgccacattttcttcttccagtctatcactgatgggcatttgggttggttccaagtctttcctattgtgaatagtgctgcaataaacatatatgtgcatgtgtctttatagtagaataatttataatcctttgggtatatacccagtaatgggattgctgggtcaaatggtatttctggttctagatccttgagaaatcgccacaccgtcttccacaatggttgaactaatttacactctcaccaacagtgaaaaagcatttctatttctccacatcctctccagcatctgttgtttcctgactttttaatgatcaccattctaactggcatgagatggtatctcattgtggttttgatttgcatttctctaatgaccagtgatgatgagcttttttttcatgtccgatggctgcatatacgtcttcttttgagaagtgtctgttcataccctttgcccactttctgatgagatttttttttttttttttttttttttttattatactctaagttttagggtacatgtgcacattgtgcaagttagttacatatgtatacatgtgccatgctggtacgctgcacccactaatgtgtcatctagcattaggtatatctcccaatgctatccctcccccctccccccaccccaccacagtccccagagtgtgatattccccttcctgtgtccatgtgatctcattgttcaattcccacctatgagtcagaatatgcggtgtttggttttttgttcttgcgatagtttactgagaatgatggtttccaatttcatccatgtccctacaaaggacatgaactcatcattttttatggctgcatagtattccatggtgtatgtgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgactagtttacagtcccatgagattttttttttttgtaaatttgtttaagttccttatagattttggatattaccctttgtcagatggatagattgaaaaaattttctcccattctgtaggttgcctgttcactctgatgatagtttcttttgctgtgcagaagctctttagttcaattacatcccatttgtcagttttggcttttcttgccattgctattggtgttttagtcaggaagtgtttgtccatgcctatgtcctgaatggtattgcctaggttttcttctagagtttttatggttttaggtcttacattaaagtctttaatccatcttgagttaatttttgtataagatgtaaggaagcggtccagtttcaattttctgcatatggaaatgggctaaatgccctaattaaaggcacagactggcaaataggatagagtcaagacccattggtgctctgtattcaggacactcatctcacatgcaaagacgcacataggctcgaaataaagggttgaaggaatatttaccaagcaaataaaaagcaaaaacaagaagaggttgcaatcctagtctctgataaaacagactttaaaccaacaaagataaaaaaagacaaagaatgacataatggtaaagggatcaatgcaacaagaagagctaactatcctaaatatatatgcacccaatgcaggagcacccagattcataaagcaagtttttagagacctacaaagagacttagagtcccacacaataatgctgggagactttaactccccactgtcaatattaggcagatcaacgagacagaaaattagcaaggatattcaggacttgaactcagctctggatcaagcggacctgatagacatctacagaactctccaccgcaaatcaacagaatatacactcttctcagcaccatatcgcacttattctaaaattgaccacataattggaagtaaaacactccttagcaaatgaaaaagaatggaaatcataacaaacagtctctccaaccacagtgcaatcaaattagaactcaggatcaagaaactcactcaaaactgcacaagtacatggaaactgaacaacctgctcctgaatgaatactgggtaaataacaaaattaaggcagaaataaataagttcttagaaaccagtaagaaaaaaaagacaaaatgtaccagaatctctgggacacagctaaagcagtttttagagggaaatttacagcattaaatgcccacaggagaaagtgggaaagatctaaaatcgacacctgaacatcacaattaaaagaactagagaagcaagagcaaacaaattcgaaaactagcagaagacaagaaataactaagatcagagcagaactgaaagagatagagacatgagaaacccttcaaaaaattcaggaatctaggagctcattttttgaaagagcagcaaaatagatagaccgctagcaagactaataaagaagaaaagagagaagaatcaaatagatgcaataaaaaatgataaagggggtatcaccaccgatcccacagaaatacaaactaccatcagagaatactataaacacctctatgcaaagaaacaagaaaatctagaagaaatggataaattgctggacacatacaccctgccaagactaaaccaggaagaagttgaatccctgaatagaccaataacaagttctgaaattgaggcagtaattaatagcctaccaaccaaaaaaaaacccaggaccagatggatgcatagccgaattctaccagaggtacaaagaggagctggtaccattccgtctgaaactattccaaacaagagaaaaagagggactcctccctaactcatttaatgaggtcagcatcatcctgacaccataacttggcagagacacaacaaaaaaagaaaatttaaggccaatatccctgatgaacatcaatatgaaaattctcagtaaaatactggcaaactgaatccagcagcacatcaaaaagcttatccacgacgatcatccctgggatgcaaggctggttcaacataggcaaaccaataaacataatccatcacataaacagaaccaatgacaaaaaccacatgattatctcaagagatgcagaaaaggccttcaataaaattcaacagcccttcatgctaaaaactctcaataaactaggtattgatggaacatatctcaaaataataagagctgttcatgacaaacccacagccaatatcatactgagtgggcaaaagctggaagcactccctttgaaaaccagcacaggacaagaatgccccctctccccactcctattcaacacagcattggaagttctggccagggcaatcaggaaagagaaagaaatagttttcaaataggaagaaaggaagtcaaattgtctctgtttgcagatgacatgattgtatatttagaaaaccccatcatctcagccccaaatctccttaagctgataagcaacttcagcaaagtctcaggatgcaaaatcaatgtggaaaaatcacaagcattcttatacaccaataacagacaaacagagagccaaatcatgagtgaactccattcacaattgctacaaagagaataaaatacctaggaatccaacttacaagggatgtgaaggacctcttcaaggagaactacaaaccactgctcaaggtaatcagagaggacacaaacaaatggaaaaacattccatgctcatggataggaagaatcaatatcatgaaaattgccatactgcccaaagtaatttatagattcaatgctattcccatcaaggtaccattgactttcttcacagaattagaaaaaaccactttaaatttcatatggaaccaaaaaagagcctggatagccaagacaatcctaagcaaaaggaacaaagctggaggcatcacgctacctgacttcaaactatactacaagtctacggtaaccaaaacagcatggtactggtacctaaacagatatatcgaccaatggaacagaacagaggcctcagaaataacgctacacatctacaaccacctgaactttgacaaaccggacaaaaacaagcaatggggaaaggattccctatttaataaatgatgttggggtatcataccaatttatgagatggtcatttggctcttgagtggaggccacctctcagtgactcagcaaaatttgtcctctgcacggtccttgtatcttgtaccacctgaggcaatcaagtatattctgctttatatcatagttatttatgagttaacgcatctccttactgggtcccaaattccttgaaggttgcaactttgccttgcctattcattttcacatactacgcggcacttagggcagtgctttcaatgtagcaggtaaccaattgttttgcttgcttttaaagtagttgtttttaaattgacttgagcttagttctgcaagaagactagatgagatatgattttgtcatcataaatttaaaatgtccttaatattttcttaatatttaatctataaagagtattcctggcacatagtagacagtaaataactttgttgaatgaacttacgcgtaaatacatcaatgactgactgctcatggagggtgccccctttttgcccatgaagttgaggtggtattgggagaatgctttcatttcctgatcctaactctcctgttgcagtctagtattgtcaatacaaaggtgtcatcattaccgttaatcccaaactgatgtaatctgaacttttgctctgtgtaattacagatatggggtacatttcctagaaaagaactgccctggacaaaactgttaggtagaaaaaaaaaaaaggaaattgggtgtcttttttccatattgtcaagagcagagaggacctcactctgccccctccctcttgactcctcacacccaatagcagcaccaatgcctgccacagaattatgagcacttcagccgggcgtggtggctcatgcctgtaatctcagcactttgagaggctgaggcaggcggatcacttgaggtcaggagttcgagaccagcctggccaacatggtgaaaccccatctttactaaaatacaacaattagccagacatggtggcaggcacctgtaatctcagctatttaggaggttgaggcaggagaatcacttgaaccccgggaggcagaggttgcagttagccaagattgtgtatcattacattccagcctaggtgacagagtgagacgctgtctcaaaaaataaataaataaataaataaaaataaaaagttacaggcacctcaaggttgcctgttttttgcctactgttgcttcagttatgtactctcagtgatctgttaccttcctttccagaaactctgtgtaaatatatcttaattcaatgaacaaagccataatggagacattggaggcattagtagccagccagtgatctgttgttttgttcattcaagaggaggttatcatgaaaatactctgtgagaaacagagttccaggattacactggcttaaacaatatggaagtttgtttctcttatgtagtagtcccaagatacatagttcagggctgctgaaccatctgctgtgcaaagtagctctatgccacaaaatcttcaagacccagcaatttctagatttctatttcaccatcccagcatggtggccctcatctgcaggggccaagatggctgctggaggttcaacattatacccatgctctagccaataggaagatagaaaaagcaaaggatgcattttggttgtcttttaatgaaggatcccagaagctttcatgtgacactttcacttatatttcatttcctagaacttgaacacatagccacacagagttctaagttaggctggaaaatacagttagctgaaaattagggtttctattactgcagaaagagggaaaatagctattgggaaattactaggaatctctgccaaagacgctatccctgagctccttacgttctaccacttgagtgccccaaatcaagacactacaaaatgaaaggttgatctagtgtcagccagatctagatgccagtcctattagcatcacttaatgagctttgtgatctctgagccattttccatgctatcaaaaacagcaataacacctccctattaggttcctgtaggatgatataagataaccagtggtgcctagcacagtgcctggcatatatggtagatacttagtcaacatttatttttaccattctttctgcatataagactggctcagctccacagtttatatcaacttgggcacaaaaacattaacaaagttcctggcggccatatttcttgagcaattttatactctatccattagccagatgtgttagagcaaatgagcggctgctcaaaagaatgtctttatcctcacttgcctttttttcctgttattgttggatggtgccaaacaagacagaagcaattaataaacttgtcagtatcataagagatgacaattagaatcagcagagcttaaaaaggagcctgaaatcataggggttgaggtagtggggtttttaaaatgcaaagagcatgccttttcacttcactctgtttatcaggccaagcaaactaaagtgaaaagtcactgtggaaaaaggtgaagaaaaaggtacctattttgcatcacccactatgtcatatcaagtaaatgaattaaaatcccatgtcaagtactgggctttattccccatggtttcacaccaagtttctcttagaagatactctaagatgcactaagctttcccattcacttctgtctaggcaggaagattctactcaagttaagaagcagtgttgccagatgcagtggctcactcctgaaattccagcaatttgagaggccaaggcaggaaaattgcttgagctgaggagttcgagaccagcctgagcagcatagtgagaccctgtctctacaaataatcaaaaattaaccagacatggtaatgcatgcctgcagtcccagctactcagaaggctgaggtgggaggatctcttgagcctgagaggttgacgctgtagtgagccacaattgcaccactgcactccagcctgggcaacagtgcaaaaccctgtctcaaaaaaaaaaaagaagaagaagaagaagaagaagaagaagaagaagaagaaggagaagaagcagtgtaatagaatgacttagtgctcagaaagtcttgagtttggatcctggtttgggcatttaataagtgagtggcctgagacaaataaataaacttttctatggctcaatattttcaactgtaaagtgaagatgataacagtgtccatctcataggattgttgtaaaaggtaaatgatacagcatatgtataaaccagatgcactcaggttttccagtctccttgggtcacgcttttctccaatatctacataaaataacctgcaaccccttttcacattccatgggaagcccatcctctgcccacgagctctgaagatttggggtatcatgcttctctcaagttatttcactctatagcctgcttcccaaatatggcccactcccacttgtcattcctgaaaccattattctatgttccctgccccctttgcttcagctcatctaaagggcaggaaaacgctggaagcaggagagtcatgagtgcctgaaattttgcaggagcagcaggcagtaagagtgggaggacctgagatctatgatagtgaaagacatgatgcaatatattgcctgcctggttaaaggagtagaaaggagtcaaagatgactgtaacattttgagtctgagtaagcaagaagataatggtgcagataccagcaagtccagaggaggatttgactttgttgacttgactttggttgacattgactttggtcaatggcaaagattgactttggtttcagagacactgatgtataatagagcttttagaaaataattcccatgagtcactagggtgcctgtccaaagtgcagtgaagggactgcatagaagaagaggcttggagatttccttgtacaggggatagctgaagcatattccccaacacaatattaaatttgtaaattacctttaaaaatagaaagaaaattgccattttagagtctcaaaaggactgagcaccatctaattacatcacaaatgatctcccaaaaaactcattcctttagaccaggagatgagtttctattcattattatttttgtagctaaaatttcaaatcacagaatcataatatattgcagtttgtttaagccttaaaatgttcctggcccaaatgcctcacttaaatacggggaaactgacatgctgaagagtctgagtgacctatccttgttcactcaagttgaataatgctgccagaaattctactgttagaatttctgctctcccttgctcattttttcacctgcagtccagctaccaaagataggattttagacattctatctacatttaaaatgttccttctaactgcagcggaaacacaggtagcaaggagacagtgtagaataaggagccagaggcctggattttagtcccgtggaaaaagaaccagccgcactacctggagagaatcatttggtcttccaagttctcagtttcctgatttgagtagcaaggagatgggtctggattcgctctgaaatgtcttgcagctctgacattccatgattcttggagaaatcggctatctccaactgaatccacatcttccaatcccacacaagatggagaagcaggcccatcccagtatttggggaggcccatcaggaccaaagctgtcctctctctgtgggggctggagaagggaagcagctgaggcaacacaaccagtttccttcccattcagaagagaacaattgagctcctcccaggggaagccatgcggatttggacagtgtggggtctgtcttatgacaggaatggaggatttctgtagaatggggatgcttagcggccgtaagaatcaaagatggaaggaaagccaagaggtccttaggtccggtcccttgcctctagctaagccttccaaggcagatggttgtcatcctacatttaaagatctccagagtagcaattgctcagcttcccacagcgcctggggtcagcaagtttccccttataatcaagaaattcttcccgatgtttaagtggaaatgcttccaatgtggcccgagtctgtttacccttgtctagtcctcagaagagatgaggaataatcttctgtgtaataatcactcttcttatgcctggtgctggtgattaagtcacttcttagccttttcttttttgggctagatcttaacttcattttccacccagttaatctttttttttttttttccttctcctagctggatcttttccaggttctccaaatgagccttaaaataggagaatgaaatctgagttcccactctaattaaaacctcagcaatgccaagttttgtggaaagattactctctaggctttcgtttcataattctctacatacacccgcctcatattacaatttgttgtagtactttcctgctcactcagggcccacagctattttgttatagtacttgtctctgccagatggagcccatttttgtctattttaaacatctttctgtttttaatgacttctcgtttctaaattgttaaaggtctccttaaattcaaatcctaccttctaatgtttctttacctgacttagtgccatctgaaaaacattctagtccattactcatcattgaggaaggaaactcaattttgtatcaatccgagaagggcctgaatagcactcatttctcccaatactcacaagcatgctttgagcatgaaaaaaaatgcaggccaccccttctccattcatttattcatgaaacatcttttgaacagggtagacactggacacacagtgatgaacagtttctgtatccattcactaatgtgttcctacatgtgtacaaaatgtactccttaagcacttactctgtgtaaaaccgttgcaagtgttgtggctacagcagtgaatagggaataaaaggctactggcttcatagatcccacattccaatgggtatgggggaggacagagaaaaattacaagtcaagcaacaaataaacaagaccatgtcaaatttgataaacgttttgaaagaaataataggatgatgaacctgaggatggtactgcctttgatggattggatgggggaggtccctctcagagggagaccctgaagacctttcagtttagcagagttatgttattctgaaccaatcccataaagcaaacccacttccctcatgttttcttctgacagacccagcactaactttttctggggtgttcacggtttataatgccttgttactcagtaattgtttacattcccaaaggactctctcatgttctttaattgaaagaagagataaaagaaggaatttaagtatacaggcgcctttgttcctcaggaagttaatggacattcctggaaaatgagagtccggtggtctattgtgtggagaaagtggacttcagtaccatgaaacagatttcttcactgtggaacttgaataggctgttcctcgaccatcttgaataggctggtgaactttaagactctgcaaaataagataacgtttacagccgtttcctaagctttttgcacggaacttcttgaacaactctttggtgaatgctgagctgaaaagatctcttggatccttaggtgtcctttgacataggatttggcatttgggatgtgattccaaatcaccagcagccaatgtgcaggccagtcgtcgatgtctctgaagagtgtgatagaaagaagaccgcagaggaaggcagggagtccttcctgactttgcctcagcttctcttgtgaccctggtcacgtgtgaactatgcttctttagttttctcagatcatggaatcttctgagaatcttctgagtgtctaaatgtcctctttccaggaaaatccacaaacatacataattatacatcatgcagagggttgatatgcctcctaccaaaatgcatctctgaactggaggatttctaaggatctgtctgtccagtgtgaaagttcaaataggtttctgctctggtcatattgacatcttggtgttttggtttgtatgcttgcttttaattgacacataataattgtaaataattatggggtacacatgatgttctgatacatgcatacattgtgtaaaagtctaacagggtatttagcatatcgatcacctcatgcctttatcatttctttgtggtgagaacattcaatatcctcttttttagctattttgaaatatacaatacgatattgttaaccagagtcaccctattgtgcaatagaacaccagaaattattcctcttgtctaactgtaactttgtacccattgaacagtttctatctccccacctaactaatgctccgcagcctctagtgaccactattctactctctacttctattagattaacttatttagattccatatacaagtgagatcatatagtatttgtcttttgacattagtttggacaagaccccaaaagcaaaagcaacaaaagcaaaaatagacaaatgggattacatcaaactaaaaagcttctgcacagcaaaggaacaattaacagagtgaaaaatcaatcttggtccatgtttttgattagcttgtgtgctccttgggacaaaaccaagcatcctaccacctctcaagcttccttcagccttcaccacacaagtggtgctaatatgtgtttctgcacctgtgccaggttcctctgcagagtcccgaggtggccgttgcatgagagactgctagggaggccagggagacccctccacacagaggtaccagccagccctggggatgccccgttgacttctcaatgagtgaatgaggtcatttttcctctgtcttttccagaaatagattcgttgagaaggcatatgctgaaatgacctagcaaggcagcaggaaggaagtgactagaaagagaatcattaaaaacccaacttcttatttaaaggaaaatggaaacaggggcctggaggaatgctctaattgggaagccagcagtggcccctgccttccctcccagtgctcccaatatggatttcctgcctttgggcactgttggatttaaagctatgaaagcctcatacacagtctcatcagaagggctcagaaaagaaacagagcttcatgtgccttcttcctgccacttatgtatggaatcagttggattaattaaccctgtttcctcagtgagattgattctatcactcgctcgagaaattctgatgattaggtgtaacctaactgataaataaaaaattataattttttttttgcaaaattaaatgtcctctgctttgtataattactgtggttctatgggcaatcatcagtggtatattcccttccaccctcctttgccacaaattttgaatgatccatgaaaagatattttgatgatgtggtactgaaggtgccccaaacccacactgcctttttggcttctctccattaccctaggaggttatagggcaaaggcataggaaggataggtttgggttcctgggaagtctgtcttctgagctgaattttacaattgagcaagttggcttgactggccatctgacaatctggaaagcttaaaaataaattgaactcagtatttagaaaaggcagctttcaatatcagaagactagcttgtgtttctcgctttccatttggcgggggaatctgtgaaggctctaatttcctttcctgagacctggcttgttgtcttcaggtgctagctggaattcaaaaggacacagactgtgcaaataaaaaactcagggaagggaaaaaggtcaacatgtgttttttgtttcagttcagtttgttactttgaagggttataatattttttccttctgttttgcaataaaactggttctgctactagactgacatatagatacctttattaggcaattatcacaagagatatgaaggctttctgtgtaagaaagtataagaggtctttcccaggactgcagttcttcccttctctccagtgccacaggacgtgatcgtatattatatacacacatattaggagttgatattgcacacaggcactggcatcatttgagaacttatggaaaatgcaagtgcttgagcaccaccccagtacctgttgaaacagcaactctaaaagtggggcctgttgatcgtgttttaataagccatccaggtgataaacatgcaggctcaagtttgaaaaccactagtatgtgttagttatcttgggcactacctgcttcaggaacccccacagaattatgggcctgaatttcatcctttcatgaggtttggggacaagtatgtgggtggagaagtcttgccatttgaaatcaaaggaacttccagattcataagccacttaaactctcagttttttcatttataaaagtgagaataattccattggcaccataaggttgttgaaatggctgatgcacaaaaggtatgtgaaaatgatttttgaactgccaggcactctctggaattagctatatggattgatgatgccaatacacattatggaccacaggcatgctgggggatgtggggagactgtgtaacctgcgtatcctgtgtcctcttctatattctgagcaccaagcccaggcagataatggccattcactgagtctttgctgagtaattttaactaatattgggtaagtgttcactcatgcatgcatcacaagcaccttgtgaggtgagtatgtgcctctttttggatgcaacctgagaggttaaggagcttcctcacatcacatagttagaaatggtatgctcaaggctcttctttaaaatggcatggtattaatacttgcatgtaacctatgcacttttcttgtgcactttaaaatcatctctggatcacttataacatctaatataatgtaaattctatgtaaacacctgttatactgtattttaaaaatgtgtattatttttaattgttatattgttatttttaattttcgttcaaatattttctatccatggttgtggacatgaaacctgcaaatacagagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattacttatatacccaaatgattataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcagggacagaaaaccaaacaccgcatgttctcattcataggtgggaattgaacaatgagatcacatggtcacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaaagagatgactgtacttttgaaatgccctctgaactcaaatgatgaaacaagtgaaatcaaaaaatttgtttttcaagtaaaaaaagaaatggtttagccagcatctgaacccaggcaatctcctccagagcctgtgttctaagcacttcaccacacaacgtcacaatcagttcttcataatgatgctaaggagggtggggtgagatgacattctgggagtgcttgctctgtgccacaagctgtctcaagctctctttgtgccttaactcacaaaaaccctgtagagggaaatgatgatcatcctcttttaacaagaaaggaaatggagacttgagactggccctggtgttaggtttcttctttccaaagtacaaatttcttctattgcttctctctttgtaccgtttgtgcacccaacttgtcaatccaccaatcagtgagcatttgtgaagtgtccaaatgcccagtgtagtgcttctaaacacagaaggatgagatgacagtgtctgccctcgagatgctcaaaatcaaataggaaagaataggccagtcttcacaaaacagaaaaaaaaggctaatatacagttaagagcttgtttatgatacataaagtaatcattttccatatttagaaggttaatgggaatgaggtcatcacacaagaattctcatgggggcctgaagaaattttgtgttgctagactgagacttcaacaatttctctgagcaattatccttgaactgttgagttcagcatccctgcattgcagtttcctttaagtttgttacagttaccctgattataaggagatagtgacctgttatcctgtttttttctgtgttgttaacttcttatccctggtactgagaatagcgtctacaattcagtaggtgctcaagtttacatgtgaccaaatgtttataaaaaggagaataataatgtggtgaaagaaggacaggagtgttcagccaaattttggattggatgagaaggcagattgtcagggatatcatgacccaaacaaaggtggagagacaccagattagggaggagccaggttctccagagaggacctgagttcagaaggagcacaggagcagagcctttgttatttaggatgcaaactctcccactcccatacactgaagtgtggtgctgtcttggcagctgtgtgttgaacctctctccctaccccagagaagaaacctcatacgtacttggtgattttctttttaagttttttatttttatttatttgtttatgtatttatgtatgtatgtatgtatgtatgtatgtatttttattatactttaagttttagggtacatgtgcacaacgtgcaggttagttacatatgtatacaagtacttggtgattttcaaagttgagagaccagagtcccttgtcatcaatttcattttccttggttttacttctacttagaaaacctttggatgccaaactcaagtcttggttacgccccatgtttccttcaaaggaaactgcactagtaattgaaaacagaaattggttcatttattctaactcacaggacacaggtaagatccctgtctgtgctccaccttggctgtctcttttctaatcccgggagaaaatctggatataattctctgctttgttgattaaattcctctggtccttatgcaaaattgtgggctttcatcaaaataggattgtctgataataccctttgactcagtaattccattccttggaatttattcttataaatgatctatgagtagtagaatgttatgtgtacaaagacatttattgctgcattagttaaaatgatgataaaactagaaatagcctaaatgcctagtaataggaaaatggttacagcaacaaatgatggcatatctactcagtaaaatattctgcagttttaaaattataattatgaaaactatatagcaatatgggaaacgcttacaatgtcatgttaagtgggaaaaaatacagtactgcattaaatttaggttatggctgtagctatgccaaaataatgtatgtatctggatgagaaacagaaacaattttgaaaaatgaagataaagtgatttgctgggatatcaagattatgggtaaaaacttctctatttcagtgtctgctaaagttgttataactttatgcaattcaagggtcttggcaggctatgaaacaaggctgactgccccatctgaaactgaaagggtcacaatgcactgggtaagatgtgagcatgcaagagctatgtcctaaactgcggaagtgcacagacttctctctcaagggaaaaagccatgcatggcattccttctggcattctctagaatacctaggataaaactctgtgcaactccatgtactcaaatcctggggttagtgggtccatttagatgccttcacccatattcttcattgatattagcatcatgtgcccacaagaatcccagtaaaggtatcaacttcagagttcttcatcaccagggaattctctcactttcaaggtgttcccgagtaaggtgacctggctttgcagcttactagatgtatgatttaggtcaaggtacttaaccttgctaagcctcagctttctaaaatgtaaaatggatgtagtaataatgctgcctccatgtagatactgcacatgtgtaaataagacaagaaaagtaatatttactatagtagcttagtaggaagcactcaataaagggaagctattggtagtgtattattgcaaacgccctgatttttctaaatgtcaaggagaaacttgtgtttaatggaatagttttcaacttcatttgattatatctttgggtcttgttatagtgccttctctctcagtagctaattagtatcctctaagtttgagtcttttcaagcgttcacgcttccatggaagtgttttctgcactgtgtttaaatcacgttagagaacttaactaagcttcaagcctagtagtgtggtatgtgtagttattctgacattcagagaaatgcagaagttcaggccagatagaaggctaagagaaagagaccccttggtgatgccacagatgactaacccagatgggggagatgagaaggctggggagctaagagccacagccagacacaagagaggaatttggtttgaaaagagagtattaagacatcaacagcctggaaagagaagtacaggctgatttgtgacctgttgagcaccaagaaaaaagatgtggcaaaagaaggcacagatgttctgaaaaatgcaaagaatttgtgatggctcagagtccaactgagggaaatgactgccaaaggcagatctcagtggaccgtgggagcactggctcgatgagaagacatgaggaggctaggacttcataactgacctttaccagagtgtcttcctgacccagagcaaggaagagagatgaagaggagaagatgaacaagtcgtttgagaagaaaaataaattagcaagtctttagaagtagattaaaatattcctgaaccagcagcctgctttttactaaaattcttttttttaagtcatcttcaatggcttgaacttacagttcagttaagaggatgtgtgtagctctgtctacattctctcatcagaactcctactactcagagtcaaaagcttcacttctttccttctatccttatcatatggaagctgctacaataccttgagggtcatttcattcgtcagcctaaaggttactaaatgtagcttttatataaacaggcatccagttaacatagtggagattacaaagaccatacccagcaggaggtcagtggattttgatattctcctttttcccaaagggaagaggcttcccattggggttacaaagtagcaggtacttggctggaaggctgagaagagagaatggaggctgccctgttgaaagactgtgtatcagaaaggaatgtttaaatcctgaacttaggccctcacttctgcttgagcagagcagagctacttatgcctaagtattggcataagtgatgcctccacacagctttctcaaacccagatgtgagacaaagagagcagacagaaggcaagtgtccagggaaataaaatggcccacaagcagttatcctggcccagtgtccctgcaccaaaggagcttccccagctgtgtgtcacattaggtctcacattgcgtattctcaaggaggccaactaattctgtaaccatggataggtcctgtgataaattggaaaatgacttctggggcaacagtctctagttctcagaaaggaaattcacagaagtgagcggttggccagaaggccaaaaggccattgcctcagagtggatcccaaagcagagtgatgtggccattcacagcatgtttgagtatgtaagaaaaaagaaaaataagaaagggtatgatttctcctgccaatatcataagctgagaatatttttctttgctgaattcagtaaaataaatcagagatttttctcgatggataattacatttgttaaaaagcatttaaggaggtttgggaatctgggcatgatgttggtcccagatgaaataaagatgagaacatgatttagcttggagacaaactgtaacttaaaccacacctctctttttctttttccttattcatagttcatttcttcaattcagaaaaatagttttcatgggggaggggattgggaggagtgcaatggctaaaaaacaggctcagtgaaggccagaagattactaagaaacctcttcagttgaccttgagtttgctgcaatatccaaagatatatggcattctaaaatacaataatttaaggaaggcatttacagtttcatggtcatgtttaagcaataatatattaagaataaaagggaaagaaataatagcagcaaaatcctgcagaaagaaaagaaataatggtctgatgagtccagattttatctgaaattcctgaaataatgttatcacaccctaaatgaaccattcagcctcagtctgcatacttgcttggtattttgaaaaaaaataatataataccacaacatgcttgagcactcttcgtatagacttttaaattttactgaacttagcagtaatttattttaccaaaaaaagaggatggcatttgaaaaactatgtttaatctttatcttctgattttatattctgggcagatgttgggtaccaatggcatagatgatgtcctgtctggaagcccattcatactatcagagataacatgtagttacggctagacatttccaaggaaactatgcatctgtccacctgaaaataagtgaatatcacacagagaactcatgtagcattgacagacaccaaggaaattagtgaaagaaaacattggcctatgttaaacactaggaaataaagcaatcttgtcaacaatattaacagtcctcctggggccgaaagagtcatttgtttaccttatgaagatgcggctttgtgaagaataaaagtaaaaggccatgcccaaggattattagaaagactcttctcatactaattctcatttctgagtgcccacagaagtgagggccatctctctttccttaggactccggttttcaaaatgtagtttgattctatcacctgcttcaaatgactctctaaagggctctttgtgccctaccttgagctggcttctgcaatccatatggatgggcttgtctccttcccctaatcaagcccaactccaaattagacattttccttcatcagactcaacactgatccctgctttccttaaattcagcttatacatcttgtttacatccaaaattaaatctaaaaaagagaaaactcttggttttctcatcaaacttctcttcactactatactcccctattattagctagaaacattaatatgccatatatatatatacacattattgattacaaagtgggtcgttcatgaccatctggatatttagggtcatctttttagaaggggtgcttgatattatctagcacatttggttgtttacatgagaaactgaatctcagagaatttgggtgacttgtgcatccacacagaggatttggggctgtaatccaatgttgttttcaatataccatattgccttgtttttattccctctctgcatatggcactgtgctaggtgctatagaaacattccccaggacctctcaatccaagaacaacactgttgatacaccagcatgaaagggacatcacacacaacccaactggcactcaagtctgcaccatgcagttatttatatcatgtaacaccaaaccatctcctcccactcgccctccctccttccctctctcctgtgttcaatctgtcgctgactctggctgctcccttctctgcgacagtgccaagagctgtttctgctgctgtagaggctgtcttccaacagtttactccctgatgcaggcccggatgcctctctttaaggagcgtccacctcccaacactctccctccagacacgccagactgccctggcagccgccaccccttcacctgccatcctggccatgtcactcccacccctgggacaaggtccagatgtgccctgagcaaaaaacaggtccctgagtgaggagactaatggggtgcagggcccctgagaacagagggcaggtgccaagttacaaagaaaaaaagaaatgaaagactttagagagaaactaaaaataaagagaatgtgttttaatatccctttggctgattcatctttctgtggcaccagaaagagggcgttaccctcgactcacgaatgccttatgttttgttacaaggcctctcttcccacatctgaaagagtaaaataacaataagagtgtaagtacaggagataatgctggtggcatagctacaatctccaagctggagccagtctcagcttacagttgtgtcagtctttctaaaaaaaagaaaaaaaaatgagacagctaaggcccacgtatgcgattcctcaacatcccttcttattctttctctggcagttttcatcttattcaggcatgggtccaagatggagtagtgattaagcggcctggtgacactgtatactgggtaactgcttattcccaaagcatggctggcaggagagggagccctggttttcagtcattccagggaggaaatgaaatgctaatacctagcctaccgtaaactccacagtggcataagccttgctcaaaagtacatcagtgaataaaaagaatgtcaaaggctgtcagtagcagaagaggaaaggaaataggaaaagaagagaacagaatgagatgagacatgaagtagagagagatgagagaaatactatgctgggtgaaagtgattgggaaaccatttctgaccatgtatttcaccacactcatcccaggccttgcagcattgttttgaaataagaagcattgatattaataccaaaaagccaatgattttaaccagtggattatttgggacaaatcaaaggtaacaaggggtcaagataagcccatacgccttatttgacttgattgaaagattcattctcatagtgtctattctagattaaaactattcagaccagtctatacaacataaagtttggacattctttcaagagaacagcctttcatttactttagtgaataacaatatctagaaaggccatctgcttcgaccaaactttggaaaggatgcatttttaagattaatggaggaagaggatacctgcccaactagctatgttaaccaattcaacaccataataataattgtcaacatttatatagtttaccatataccagccattgtgcaaaacactttgcatacattctcacttaatcttcatgccagtcctgggaggtactcttatatatcctttttacatatgaggacctgaatcttagaaggttgagtcctttgccaaatgaaagcttaacagtaaagaaacagtagaatccagactgtctggttccaaaacttgtgcttttagccacttcacatattgcttctgtcattggtatgacagatgtcacaggcagatcatactcaaattctgtaatatgttctaaataatacaaacaatataactagaaaatggtagctaacttatatagcaggccccactgaaataattcaaacataaaaatgacctcttggcatttgattatctttcaccttagacgttgataaaccaaaccattcccttaggacaatatttttctgtccagcaaagcatttctcttgccaaagtataattttgttggctacatctatctcctccaagccctggaatcagacctaagctagtaaattgtgctgtcctggcaagacactcatcctccagggcattgtatcaggctaaagtaatacatcatgttgcttcccactctgtctgcccatttctccaaagagtcctaaaacagtaatgtttctgctttgaatctcttgctgttatcgcccctaggacttgcactttagcttcctggccttggaaaccaaggtgagctgaatagcattcttttcacacctgctcttgacttgggcttccaaaagaaaggaggctttcaacaaaggggcagccccatagaactctgcttcattccttttagactcagagaaacaaaaacattgacttgattgggtaacggaagactttggtcttttgggttatggggatttagtagctgagaaagagttgctgagtagtgagggtgggggcaggtcgtagagggccataattcctagaaaaagatgaccttgtccaattgagaggtagtgagaccagcaaacactggcaattaaaaattaacacaggccaaaagtgaaatcgatgcctaaatttgataggttttcaagaaaagtttatgacatgcagttcatagaaaagagaacattttctcagtgttcacttttaagatgccaaaggtcaatcttacttggaaagatccttccacagaaaagcagaaatgtacagggtctcctagcaaagtataaggcaggcaatagatatattagaaaatcttttttaaaaatcctaatttcaaaatgttttacagcagctttggtactacagtaattcacttaattccctaatatgtgtttgagtatatgtgtgtacatactcatgttattctaaacataaaaagatgtggccagttgacagtagtaaaagcttctttccatatctttactaagcacatgacaatgtataactcaataattgctttaattcaagttgtgatttcaatagacaaaaatttaaaggcaaaatattgactctcaaaaggttttcaagtaaatgcaaatcctatgaattctggaaatatcaaccattcaatgtattacattggggtcttggtaataatataatcacaattttccttatattagaaatttatgaaaggactcaagtcttccttataaagccatcagagatgtaggaaatattgggaggtgattctcccttttccacaaatgaaaatagtaattaaaatgctaaaatgaagactactttaagattattcatatcttatacaattttcctactagtatctcatgcaaaataatgcaaaccaaatgaatttatattaaataaggcggcccagggagaaaatcttgccctaaaaaactaaccgttccaagttattctaaattggcaatgtgtctggagttctgaaataaataactggtgtgaaaaacctaagtttccagattcttcagatcttaactgtaatatttggttgtgtaatcaatccttagttaatctaagtgaaatgcaggttcatttttattagctaataatttcatttgtgttttttatcagacatataattgaacattttctagaaatagcccttaaaatccaggttaattgtcttacctcttttttcctcctttcaaaaaaaaaaaaaaagggatcaactttggaacctcttcctgttagcaaatttctaaagaatagttttattccttagaactcaaagaataacaaatgtatatcttaagaactagttgcttcccaacttgaaaacgtttgcgtttttttattatttaaatactgactcttcaaatcaatgtcttccctttccaatgatagagttgaaatagttaaaataaaactttctcaagaagcaagatgggaagtttcaaaggaaattaaagctgaatgcattgttccaactgcattcccagaaatctataagaaacacaaacttatgcagcatcagtagaggaggtagtaccatttttgccagtgatgaacaaccagagtcctttgttctagaagtgatgaccccggttaaatctcagcattacacatttcccttcagagatggaggggagcgagttgcttgcatccattacaaaatgtgagactcagctaattggtgtggttttgatgatgccacagttctgcccaaaacccttgtaactagcaagtttgccctgaagattattgaattactccccgaccatgcattatttaaagggaagtgctgttattatagaagccagctgtttaaccattggaattctgtctgttggccaacttttaagatacagcagtacattgtgactaaacattatgtctagtcatggaggagtcaaagtctaggataggtggtggccaacttgtctggtaagcaatctttggtctacatgctatgaaacctttgaagcaaaactgacaaaataaatatataaatttttaatgtcaagactttgtcagcaagaaaaattatgtggaatgttatacatgcctattcattctaacagttgagtaagtgcatgaacacttcctcatgccagtacaacagaactgttggaccacaccttgctgtagaagggactataccaggcaccggtctttttttttttttttttttttttttttttcgtagcatcgagtaaggacaattaaaaagtgtttagagcatcttggggaacttcaaatagatagaaaacaacttttcaccttctaagttagaatatatttgcacctcttccttgaagtggtttccaaccatactgaatattgggcccaagccagttttctccttcatctcttcacttgttatagaatgtctggaatagaaaagaccatagcagtcatccactgtgttcaacataggaatcttctgctaggatctctgacagatgtttattacagcctttacttaactgtttcctgcaatggggagttcattacttttcattgaaatctgtcccatatgtaacacttgtaaattcaaattgttaggaatgcttttcttatattaagccaatatttgtttttcattcacctaccagctctgattctgcccactgggacagaattatacagcacctaatgaagagtttctcaaggcaaagataaaacaattagttccatctcatttaaaaattagtcgaaatgacaatagttataatttagaagtcattaaaaataactatctcaaataggaaaatgtcaaatactgaagccaattgttttattagctttctaataaattacattgtatcaggcctctacctgtagaccatagcagcaaatatctttattgtggttctggaaaaataaacaatatgtagcatttgaagatatggaacaaaactttgaccctcaactgtgatctttcaattggcgagaaatgagttttttgtttgttaaatattttgatgtagagccagaagaaatcaagcttacagggcacttcaaaagatgaattaaacttcaaaaggcaataggtaaacacttgttatattcatatattcccaatgacgtacaatgagtccattgtagacattatgagtagacaaagaaaaacatctctctaggattgtggtagctagagataattggtaattatatttatggcaaaatcgaagtctgtataccactatttcaacaatattttttaaaaaaacaaatgtagacataagataaactttctctatggaacattgcagaaaagtcctaaaattctctgtacctaaacccatcgatctacagactaaaaagcatgagctcagagtttagatgagcttagagtttgactgagtcatgtcaaattctgagctcatttaagcaaggtgataaaccagatgcctggtatttcctgttattttttttgctgtgatgatgatgactttctattttacaagaggaaatcgacatgtggtgagtttcatggttgtttacagtcaccaagaagtgaatatacaatcatagaaactctctctgccatcccaagatgaaggttaatgtcttcctcttatagcagacaaggagctccagcacctgtgggacctcagaagcagaattaagttagaggagcttgaaagggaaatactaaataggtcctggaatcccaaagcctgcccttgtctatcttcaaaggctaaccatgaattttgaaatcagttgtttctgagttggctaactttgaaagtttctggagctcttcctaccagcccacccccaaacatcaagttaccatttcataatcaacaaatgaatcccaattacatcccattaggaaatttatagtttcaacaaagggcaatcattacctgtaatgggcaaaagatacaatgatcacaaaataggccaagtcaccttttccttcctccccacccacaagagagaagccaaagggtatcagctgtgctttactggctagccacttagcaaaaagtacgtagaagtcctttgtggattacaaaggacagtgtaagcccatttgtgtctttcctctaatttatagttccaggaaaagattataaaaacaaaaaaacaaaaaaatattgtttacattgctcaggggacccgctgagacatggcttgccaggtcccagtccctcccaaatgccacagccattgggagtccacagggtctgcttcgagatctgcacagcagactctgcccagaaagaccacaaatgaaccctcactgagttactacctccagctgccctaagaatgacaataaacctgccttacagaaggaagcagccaccagggtcctgtgccaagcatcaggaaagcatttgggttcttagaggttgccatgaatgctggcccttccagcagggaggcagccaaactggtttggtagcaggccattaccatgggcctgatctcccccaatgagggagtgcaaaatacatgaggattctgactttccaaaccctatcctcaagtaatggtgtcattattacagaaacatagacttgtgatttaaaacgtaatgttttcttctgtcaggaattaagattgaatacatgtcagattaataaattggattcttctgtgcccgtgatttataaaatttcttccataaagcctgagcatccgtggagaagaccaggagagataagggaggagaagagaaagcaagtttctgtccctctgcccttgcctgagctagaacagaatcacatgaaagatggacatttcgttcactgtttcagtttggcagttactcaataagaaatagaattcattgttctggcctcttggggtggtaagagagggagccctactagattggtattgtaattagtttcaagtcccaagacttctgtacacggtcaatagtgacaatgcttcttcacaaaccacataggatcctggaaacggtactcgcagaaagctggctatgatttacttacgacttacactatatgtcaggtgctgtgctatgcattattcatacttgatttcatttaatcctcaaacaattcttacaaggaagatattattaactccattacataaatgggaaaactgaggcccagagagcttagtgacttttccagagtcatacaacagttctcctgggctcctcaatgaggcacttgggctttgcagcaagtagatctgagtttgcatcttgactccacgacttactgcatgaatgaccttcagcaagtctttgccacctctgagtctcagttttcacattagtaaaatgaggagccctttccaaacttaaaaactctttgatgttcaacctgactatatagtcaaagcagttaaacaaaaaggcaaacatgtgagctgtcctgcttataaaagcaatgcagcgttgccaacaagattaagaaaacaatgcatgatcttattttaatatttctatcatcctctgaagccaatatataagaaaagactaggattgggcatagacaagatccttgcctacaggttgcaaaacttggggagagttaccacaaatagcatggtgaatgagttagtgctaatgagtgtggtacagactccgggagacatactggcattcagaaagatacgtggggtcaggaatcattggggaagtttcaagaagaggttgagacattgcagaatatgtaggttgactagctgtggggagaggcaggagctgggtggaagactgaagaaagcagattgcaccctaacatgaggccactctgtttgatttgtgcagacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggtaagcccacctgggtgggatccagccatcctcaagtggtctctctcttgtgcatgtgggtgggccaagcagaaatcctgccccatagtctcctggcttacaagtcagaaaagctcctttgcaccaaagggatggattacatccccatctctttggtcactctgcattgcaaatttcccctcccaccgctatggacgatgtgatgattggaagatgttacaaaacagtggctaaacaaacatgggctttggtgtcagacaaaagtgaagtcctggctttctcacacaccagcttagagcccttggcaaataatgtgatgtacccaagcctcagtttcatcagtaacattgggataataataatatctaccacatcagtttgttgtcaaaattaagtagctcatgcatatactttgagatgcttttcacatgcctgcataaagtaattgttggaccatcgttaatgtctgccataattgcacttaataacaaagcttgtaacctttcaagttctgagattctacaatcttccaaagaaaataaaaggctaatgggaactattcaaaattcatattcagtagcaagcataattaaacatgaaacattaaaaatagaaatttctgtttggctataagaatgcctagacatttgtaatgatcaaaatctgcaggcatcattttctaagagctagactgtaaacaaacctcagaggtaccaactatgccatcagtagtacataaaacatctgatgcacatttagtcacttgatcgatttctcttgaatgagtgaacgaatgaacaaatgaatataagagattaaaattttagccattaagtagaaagaataagaactaaagagaaggtaaaggaggaaaaagagaaggcaaggaagttgagtaagggaagaaatagctctcgtttaagtattttggggactctgttgaaaaaagaaatgccaacatgtggttttaatctttggagctagaactaataatattgtgcaaaagcacaagatgagagatcaagaagttcaccatgacaccttcgctgcttcctggtcttaaacctcagctgaggctggaagaggaccatggtggcttattggagatgtgaccccagggagcccctctgaaggatggaaggggactgggcaagacccaacacacacagaacacagtagccactggccaggcaggaagcaaggatctcagaaaagacttttaggtgaatgtggcaggaaagcgtgcttgctggggcaaaggcagattcattctttctcttcccaggtgacccagcgcctcttggtttctaactggggagggggtaggtgtcaagagatgagtcccaaagttctggaatggtgggtcttgtgactgaggtctagacccctctccagcatgagtgctgtctcctgcatcatatggagcctgggcattctgagctcattcaaagggacaccatgggaaccacttgttctcaatgcaattatttttgtgatgtttacagtatcagcccccatctaccaacaagaacacgaagtctcagagaaggaaaggttggccaaagacacatccaggaggggaacagaaggaggggacagaagcaagtctgcagatcagaggaaagaagaaagagcagaggagggagattggaagtagaaatgctgaatgcagaggcaaaaaaggaaaatgaaggacaggaggattaaacagacagaggcaaggatgatgagagaggagcagacagcaagaatgaaaagcagaaaatacaatagaggaaatgaagaaaagtaggcctgctggagctagatgatgatgtgatggaaatagaagtaaccttttagagaatctcgctaagaaacatggagaaaacggaaaagaaaaatgtaatgccctagaaagcgcaaagaaagacagtggcaaaaatgaaaaaaaaaaataaaaattataaaagaggcaaaaaaagacacactattctctgcctctaaaacacaattaaataaaagaatttaaataaaaattaaggcttctatatgcatttttaaattttgtatgaatctgttatggaagaattgcctatgtcaatatatgttcagagttaaatattagccccaaatgctcagcaagactgaattgtgtcatagaagttcccagattcccttttcccgcaatgtcattggaggctgcatttcttagtcaagtccagggtttaggccaaagggcatccggtattgcctaaaaccctgtgaggtctgtgaggtaacttttgagaagaggtcactgcactcttcatcttttttgcactttggaatcagatataaaagatgtataagtttgctagggctgccataacaaagtatcataggctaggtagtttaaaccacagaaattgattttttcatagttctgggagttgaaagtccaaaatcaaagtatcagcccttgcaagggccttagagaaggctctgtcatgggctcctcccctcggcttgtaggtggcctccttcttctccccctgtgtcttcacttcatcttccctccatacatatctctgtgtctaaacatcctctgtgtgaaacaacaccagccaggttggatttgggcccaccccactgacctcattttaacttaattatctctgtaaagactctgtctccaaatacagtcatattttgacgtactgggagttagggcttcaacacatgaatttggacacaattcagccagtgacagaagacttctgatctctgatgataaccactgcattttgattacagctcctagaaaacactcccctccaccaccccaccacagatctatttttatatctgaaaccctgagtttctgctccatgagaaccccaggaacatactatgttagatctggaagaagcctcagaaatccccttattttgaagactaggacactgagatccagaagtgggtaaagatgtgcttgggttctaagctgctcttcttttggccaggagacaacagcacataatcaaagtgggtcaactaagaaagaattccagaaggaaaagagagggcagaaatgaagggagagaatgagagcaaaagtgctggatttccctgagggtgaagaaaagttaaatagaatcacagaattcagattttagagatcttctccttcagatcccttggtttaatcagtaggattggggtcttcatagataataaagcaaaaactctcgccatcctccaagttgtgaattagaagagctgagaaagggtacaagacggaagttctctaccaaacaaatggtgacattttggggtaagaatatgactaacccagaagtgaagcatttcatccaagtagtctattttgaagatgtcatggtataaaggaacctcctttctgcctggtcctccatgcctctgccatgctttttactccaggatcaccctttctagtggttcactgaaaacccaggattacttaaatatgatggacatgttcacggctcaatccaggaggaaaaggtcgaactgaaagcatgccaaagccccacatgggagccaagccactgctgctgtggttgcaaagtggatcctggcttatcagagcagagagaagccaggctcgtgccttagcccaagtggccagtcaccttattcaggagatactaagttctccagctaagacatccatgctttgggaccagctgcagacagaagccaattcctactacaaccatcaccttagagtagcatatagacacagatggctcttcaaaggaccacagttccatggaataactaagaattcatgtcctgtggaaaggtttgaataaactataattatacccaatcataaatttcattcaagaagaactaaagcaaaggcaaagacagagagaagaaggaaggaaggagggagggagggagggaaggaaggaaggaaggaaggaaggaaggaaggaaggaaggaaggaaggaaggaaagggaaggaagaacaaaaagactttctagttaaagaatgcttaactagcaaactatgtactataagacagttcttttcggaatgagttttatcaactctaaagcaattatcttgaatgcctacatgtgattactgaataatatgaaccaagaaaacagaaagaatctatattatctttccatttccttctttccagtatcaatacccaagcctctagtgatacatggcatataatgttggatggatggatggatggatggatggatggatggatggatggatggatgaatggatggttggatggacaaatgagtaacataggctgatgaatagtggtagaaagacacaccataaaaacaagtggcacttctgagatgaaatgattcctattctcctacacaagacagtgaggcaagtacagagtaaaaaaggaaaggcataggagctatgcttatacaagtattgtatgtttggaatttccttcgctggccaaattgaaattgttcaaggacctattgctacaggtggcaactggctaagaatttcatagtgaatattatacacctattactccccttaatgtttctttgaagtaagcagaatattaataatcatttaaaattccagtgtttcaacttcaattgtttcctagggcaaattgataattgtgtgtaaaactaattggaatatgtatggaataatcatcctgaaataaaattggtgaaaagtatttgttattgggcatctacaatgtgcaaacctctgtactaggcatgaacaagagttataagcattggagaggctaaaatatagtccttaaggctgggcacagtggctcatgcctgtaatcctagcactttgggaggccaaggcgggcagattgcctgagctcaggagttcaagaccagcctgggcaacatagcgaaaccccatctctactaaaaatacaaaaaaattacctgggcatggtggcacgcacctgtaatcccagctactcaggaggctgaggcatgagaattccttgaacctgggaggcagaggttgcagcgagccgagatcctgccgctgcatcccagcttgggtgacagagtgagactctgtctcaaaaaaaaattaaataataaataaatagtaaaatacagtcattaagagtacaaaatgtagattcagactacctgggttcaaatcttggctcttacttgcattgtggctttgggcagatcatgtaacttatgtgtgcctcagtttcctcatctgttaaataggggcaacaactgaatctaccttattcagttgttgtgagggtttattgagattgtgtgtgtgtatgtgtgtgagtgtagtgtgtgcatgtgtgtgtctgtgcaaggagtgggaggtgtatattcagagacacatattacagcacttaaaatggtatctagcacttagtaagcattattcaagttttagttaacattattttacttacctctgaaaattggagctatgtgaaaaagaagttggtctcctgaagtagaagccagtcttgtgtcaccaaaaacttcaagcccaagcttgccaacgcttttccatgatgtggtagtagagtttcaagcatgtggtaggataagagaactcaatgacctaagaaccattccaacccagagaacccctggttctatgaataattccaacttaaataggtagcttggctctcccaagtgagagccattgcttctgtttccgggtcatataatgaactttcagaaaaccaccatttttctcaaccagttaaaattaagtgtaatacgtgctttcatttcatggtgcctggggaaaatttaattgtagtatgaactccagttattggtagtcttaagtaaaattgccaaaataaatagaaatgcaggatatttctgggctcacacagcttccgggacactttagtttcttgggctgccaatccagtgcctttcacaagcatttgatcttttttcaaacatctcttgaaaacaaacaaaacctcacacagcttctaatgtgtgcactgttcgaatgtaagggtggaaaaggaggcaaagaaatgagctcccaaagagcaattccccttctctcgcctccatcccttgacgacctccctcccactaaagggaaacattgttttcttaggtaataaattctgcaatttctcaagtccattaacatccactgggcaagatgagatctattctttttatttgcccataggaaaagaatagtgcttttttgcaatattcactagataacacagagttgacttttaatccaagggcaacattgatagtctctagttaaaggggaagccttcaggagcaatgaaaagattaatagttttagatgaagcagaatccaaatccctttttatgagttttgaaatatccagtttgtatgctcacctcaatacttaaagcccagttactgattcctttggcctaagcaagacaggtcaatttttaaagagggagtagctgaggttagcaaaaattctccaggtccacaaaacttccagacctgcaaggtgaaaatcagcttttctgtcatccctaaaggcctaactggaatcagaacttttccctgatgcccacatatttggaggtccttttttaatgggactccttaatgcctttagtgccatcccattttcatccagtgtccaaaagaaatgatttaaaaatataaacgtatgtttaaattccagaagagagaaatggagattgagaacaatagggaaatgatgagagctatgggaaaagaggtttatgagtccatgtctgattcttccagagagcccctaagaaagttcttatcataccaggaactcaattataactttcattgcctattgttagatgagtaacaggagctagaaaacattttggaaattcccatctttatttttttaactaatatgattatagttttaagaaccattggtcaagaagctaactttttaaaaagtggaagtatgatggttagaaataagaatgctaaaggtgcatcaagctgattttaattctaaatgtccttggcagcaatttagaatctgtaataaactacaccaaacagttttgaggggaaggggattagtttctccccttccttcgtgtgtgtgtgtgcgcgtgtgtgtgtgtgcacctttgtgttctagcattgttgcacccattacagagctggggggaactattttccaaaattataggtgagaacagtttcttggattgtctttcagtgaaggtaaattcctctgtaaaaactaaccatcattcagtaaaaactgcaggattcctttgtcttctcaaaagcctgtttctcatcctaaattaaaaattattcaggaaatagagaggacattattggaggggtggaaataagttggttttctttttattgtatcttttgaggatccagggacttctaccatttcccatctaacatacagagaaggattctctaggtccctgtctatagactgcagtaactttcctatagaaccaatttgcaattttagaaatttctaggtctaattattgacccattacaaccaaaggtcaatgcatccagccaatcttccttctatcatcccctgcccttacttctattagggactgggattacaggcaaaacccatcaaatgcctcttctaccactttcccatttcttaaccattagcctctaacttcctctattcagtttctcatatgctttcatgcccattgggtcagataaaggaacattcatttatttgagtaggcatctgttatgatcactccggaaaaaagatgacaatgggttaccttgtcctcctgggcttctctaactgacatggtcaaaatgcccatatgaagataagatgttaagagcaagatttatgaaaagctgagtatgatggcagctcttgtctcataaaataactcgaaagttcccagtgaaagaccaagaaattttacatcaaacccaaaccggccaaatggtccaagcttccaagctgggatccatggctaaagtttctacaaaattctgggtacaatgtataaacattcacttggggctttctgtctagccagcaccaagaggtcaagtaatcaaggaccaactagccctgccatctgtgaaaatatgtgctattttcacggctttagttcacaattatggcaagacaaaagttccaaataattaggagcaagaccatggcaggttgacggttgagtaaggttctcaatcagccgacaattgtagagttggggatgtgcaatgtttatgtcatggtgtaagtatgtggcatgcttgactagcttgtgaggcactggaagactagaaggaatgaaaaatatgaatgaatcaataaatgcatagtataattactgttattttgtcagtattgttttacctaggtcactattgaatgctctgatttgtctctttataaataataatatgttttcttcttcaaaagaacactaggatgaaggtagaggtgcttttggcacaatgccacaattctgatttttttaaaactgtatgcatgcataaaatgttcttgagccattctctgccttggaatagcactggctggcattctgcatgtttacttttatatgctgaaggcccccatcaacctcaaacagaggcaaatcaatttaacttctcatagtgttattttgttcatcctaaaagttcaagagagccttccaaacttccaaaatttctctcaattcagtgaggaggaaaattcagaacacagcatttgaatgttctgcccagatttgtcacacacacaaggaatgagtgaaagagggcaacaccctttcctcctaaccctgtgaactcatcactattgcattgaaatgacaccaaaaggtaaaaaccctaggcctcacatctcccaagaacactgcaataggagttactgcatacaccagtttaagtaactctagcataaattgtatgtcagatgaaacaatggcattttggaggcttaagagaaaaagaataatcaaatccagtttttaggtactaatgtgctgaatctttagcacatagcagcaaaattgctagaatctggtgtttcactttttaaaataccacatttgaacctttcagcaattccaaaatcaactccctctgcgaaagataataagcttaaacattttttaaatttaaaaatgtaacacaaacaaacagctaagcaaacaagctgcccataaaatcaacagtctggggagccctgatcctgaagtattttacaacatccttcatgactattaaaggcaacataaacacctcttgtcagcaagggaaactacccttggcatttttttttctttgttccccaggcttttaaaccattttgatagagattttttacatcacaggcagaaatatttgaaatagagtcaggtggtagtctttaaaagagtaagaaagttgctaagtcaagataatcttggaataaagtcctctgattcctggggattcctagggatgccccagtcactagaaaacagagctgtaagtccactctcccagcactcaacggagctccggaaaccaaggagctagctactgtttccccacattcagccagagaaagggcagcactctagcatgcaaactgctttgacaatagtaacaattaaaaagtaaattaaaaagaatcataatagctgatattgattaggtacttgccctgtggcaagagctatagggaatcacctcatttaatcttcacatgaagcttgcagagtgagtaccacaattatcactattgtatagacaggaaaactcaggctgagtatggctaagtgtcttgccaacgtcttgggctaacaagcggtcaagcagaatccaaacccgagatagatagaccacagtgtgctaatcaagcactgcactctctcctgcatttcttagttgatatttaccatatacaatctgtcacttgtatgagatggcagggggttctgtgctatttgtccttgtagagaataccacaggaagaaagtaagcagccatgcaatatttgctgttgacctgaactccattccatcattcctgcaggaaattcgcatccattaaatgagcatttcctggtttgccactttgctcaaacactttgcttggatctggagaggatatagaagtgaaggaaatatgctacctgctctcaaggaacttatgttttagtggagagacaaacatgcagaatttactctacagaacatcaatgcttgagcaaatgtagacccagagagggctcttacagcacacaagccagaacagactgatggtgctaacaattaggttcaaggtttttctaaacagtagactctcctgcatacaactataccgcatgccaggtaaatgactgagggttattacatccaattataacaccactgtgatgtaggtgctcttaccccacactttcattttacagaagaggaaattgaggacagcacaatgtagtgattatcaaaggtcacacgactactgtgtgggagagctaggatttaaaccagatgcataagatgaggtcctccaagaaacagaagatgagaaggtgttaaatgagcaggggttttattagggggaattaatgtgtgaacagaaataggggaggataggcaaagccatcagattgcaaggcaagcctaaccccaagggaaggagagagagagagtagattggttggaaacatttttggtgggtctatggtctaaggaaagttcagcaaagtcatcatggagtttttgagccaaagttgggcaatacagttgcccaacaaatttctgtgtttctcagaaataggtctgcctcaatgtccccaccatacttggtcactggctcttgggaggggcctgccctgttccaatccactagagccaaagaagagccgttgtactggcagggggtgggggaattcctacaaccacataaaaagtggggtgaggtttccagaaaaaaacgtgatgctgggctaaccaaaactgtgtccagtaagtacatatccctcactctgttaaagaagcagccacataaacaaggagtacacgtttctcaaaatgtgcaccttgttctttggttttgaagtcacatcccaaagtgctgagtagatcgcatgaccctcgctttgcctggctgccagagaggaaaggctgatccaactctcctggaatttgaacttgtgattccctgaagtaaagagatatcaaagttgatactgagacatctaaatcatcctccaccatttcacatgtccccaggccaagccagcaaaattgctatagcacatccctttcaacaggtaaagggctgatatctgagccctctttccaatcatccactgctcttttcttctcattttgccctttttgggagcaggtcaatgctgagttagtactttatgctgtacaataagctgctgatattccatgctggacagaattttcccagtattttttatagagtgccaggcttttcctagacttcatgtcatacaatacttaacttgtttggagtgggtggagatggaaacatagtctattgaaaacatcactgcttcctccctgaagtttaaagagcctatttttatccttttagattctatctctcaggcaaaatctcataaagataagtggggaggaaaaaaagggggttataatacctagggagtttgcttttgctaattgaatactgtgctcctagacttctataaataccattacaaatgggtcccagcttgtggtaatactcaccctcctcattgagtcttctgtcccatggcacagcctttccctccaaactagcatctacccccatctggaagcatgggcagctcatgatattatcaactattgctattggaaagtgatttggacttgaaagcactagatattttttacctcttggggaggcagtttagcagagtggttaactggtgagctccagaatcagaaggaataggtccaaattccaaccactattacatctccatcataagaaattaggcaagttgtttatcctaagtttcagattccttaaagataaaacagtcaagacagtagtacttatccctgagagaagtataggaaacaagaaaatatatgcaatttacatacatactacaatccccagcacatgacaaatgttcaagtaatgggaactgttattattttagccctttgtctatcagtttgttcctctgtgacctcaagcacattactaaatgttagcgagcttcagcttgtacgtgggactgacaggaataacaccgcatcacctcatgtggtgattgtaaggattcagtgatattattttgtaaactgtaaagcctttgcaaatgttaagcaagattattattattgccgttgttattagtcctcagtgatcttttttttttttttttttttttttttttttttttttttttggagacagagttttactctgtcgccaaggctggaatgcagtggcacaatctcagctcactgcaacctccgcctcctgggttcaagcaattttcctgcctcagcctcctgagtagctgaaactacaggcacacgccaccacaccaggctaattttttgtatttttagtagagacggggtttcaccatgttggccaggctggtctccagctcctgacctcaagtgatctgcccacctcggcctcccaaagtgctgggattacaggtgtgagccaccacacctggcacagtaatcttaattgaaaagtctgtggatagctttccaaaggaaagcttggagcttggataagaaccaagagataatgggagaaggtgaatggcctcttcagggccttttctagcaccctaaatatgcgtgtctgtccataatgggtaatcatatatatcacaaatcaaaccctccacaaacttatttcctaatgtgtttgttaacctttccttctaaagggtaaacttctttaaccaaccccagtgagctggaggatcaatgttttcttaatagtcttaccttcgttggtgtcaataggaaacagtatttactcactactgttttccttttaaaaatctgtctagttgcatactagaaacagtttcagctggtttgtttgtattggacaagctgctgaagtgaaaagtttttgcttgactgaatgtgagacagtttcataactcttcaagaagtgcaccaaaggtgggtgccagctctgatgacggctgcttctaacatgcctccacttgccgcccattgtcaagggtggctggcgtaattaagttaagacaatgagcaaagcaacagatgcaactgagacctagtccctgagtgcttttgttttgtcactgtcattgtctgcaacaaagaagtcacatgtgacagcctgggaagagagccaaatgcaaaccagacgatatcccagctggtttgaatggcctccaccgtgcacgtgtgtgcatgggaatcatgctacttggtacagcatctgcttcactcaagtgagtttcagcccatggctttgctgtgatgctgagacagacccagaagaaacagaccagggaatccctccgctcagactttacactttataccttgtgctttgagagaaaagaaaaagaatctctctattggagacaaaaaataggatgtatgtggttggtcaatctaacctcaattctttttgctatagccccccgctaatttaaagagtgaagcatagatggtatcttaatgttttcttgtagaaatttgggattaatttggcttgagaggaagaatggagattaaacgctttatgaggctttcttttaatttgttcccatttcattcctgaatattttcttagtttgggcattgcagatgtttaaagaacttcttattttgagctggtatgcctcttaaacagaaaaacaaaaggtaaaattcaaattagtgtgtttctccgcctgttaattaatttggttagtagttaggcagagagatggcatccttaataatatctattttgcgggtttgatcagctacagaccatcaacagtgttgattgagaattgaacaaaaacatttcaaggagtttgggaacattagggatgctattctgtggccccatgtgtccttctctcatttttctagagaactcctataagaaagcagaacacggccaggcatgatggctcatgcctgtaatcccagcacttcaggaggctgaggcaggcagatcacctgaggtcaggagttcaagaccagcctggccaacatggtgaaaccctatctctattaaaaatacaaaaaattagctgggcatgatggcgcgtgcctgtaatcccagctacttgggaggctgaggcaggagaatcacttgaactgggaggcaaaggttgcagtgagcctagatcacaccactgcactccagcctgggtgacagagtgagactccaactcaaaaaaaagaaagaaagaaagaaagaaagcagaacccaatggaagattaagaacacacatttagcttacgcctgtaataccagcactttgggaggccaaggcgggtggatcacaaggtcagaagttcgagaccaacctggccaatatggtgaaaccccatctctactaaaaagtacaaaaattagccatgcatggtggcaggcgtctgtaatcccagctactacagaggctgaggcaggagaatcacttgaacccgggaggcagaggttgcagtgagctgagaacgcgccactgcactccagcctgggtgacagagcgagactccatctcaaaaaaaaaaaacaacaaaaaaaaacaaaacacaagtttactgggaacttagcagtagatgctttgcaccacaacaaatgtatcttaagtggtcttttgtgatatttgagggaaagtgccagaatttaaaacaaatggcatttcaagttattctatacaaatgcccagtttctttctaccatctttttttcctttttgcagtggtcactgagctattttagtgaatgtttttacacaatgatgccatcttccttctactcagtcagtacaagatgttgaccatcgactcataaaacactagctacctttcatgaaggacttggtgataactctcatgttccaagtagaaccggaaaacatgtgtaagaaaacctgccgatccctatgggccttggccaataggtattattcccaaggggtggcagtttatctttttccccagccttcatattaaaacctctcaccttctccaggtctcaggtctgtgtaatctcaaatgtgctttagctcctcacaatattgtaactgtgtgggtgttcattaccttagccagaagacagtttacagattccaggtctcatggagagaacttttgtttttggttatgaacctcactgtataccaataattatccattacatccttctgtagagggctctctggctagagataaaaccaaaaaaagaagtacctcaggtttatgcatataaatgccagttcctccttgattttatttcaaaactcctgtctacatactttgcaatttaaatacattcaaggataaagtaataactgtaggaaaagtattataatataatgacttagttctgcacatcacaagggggtccctcatactcattcattcatttcactcattttacagatatttattgagcacctgcaataacctgcacactgctctagacactgggactataacagtaaacagacagatacatctctggtctcacagggcttctattctaagcaaaactcaatatccaggccgggtgcagtggctcatgcctggaatgccagcactttgggagaccaaggccaggcagatcacctgagcccactagttgaagaccagcctgggcaatatagcaaaaccccgtctctacaaaaaaaaaaaaaaaaaaaaaaaaaaaattgtcaaggcatggtggcatgcgcctgtggtcccagctacttaggaggctgaggcaggaggattgtgtaagcctgggaggcagaggttgcagtgacctgagatggcaccaccacactccagcctgggcaacagagtgagaccctgtccaaaaaaaaaaaaccctcactatccttaagataacatcattgcttgttgatgagtgaatgttaacaccaaattaggaacccaggacttttagtcttggcatggttactttccaataaagatgacaatactaagaagagaaaaatgatttaataatgataatagtggctaatacttatgtagtgcttaccatgtgccaggtctattgtaagtacttttatatatattaattatttaatctttgatcctataaggtagatattattgttaccctagtttatagatgaagaaacggaaacacaagagattgccactcatacaagtttacacagccagaaaatagaaaagctacgagttgagctcagcccagtatgtctatgattttacagactcaaaattaattataagatttcctaatcttcgatttctgaaactctgccttgctctagaggaaaacaagaaaaacaatgaaaaataaatgtctcttttttacaaaaattaaaacagaacaaactgcaataaaacaacagaggatgaatccagaatgtgattgattttttttcttactaggaaaggatctagaggccagaaggctggatttttcaggatctcctttcaatcaatgaatctgtgatagaagcagatgaatcaaatctcatctttgtgtgattataaagctgtctgtggtattcacgccaccaggggtacatagaagatgcctgagtgaggtttggcaaaagtactaagggcctgtccacctatacatgcccttctcaggaaaaccaaggttcaagctctctattagctcaactggtaaggcgtaagacatggaaggttgaggcccaatgttagaaatagatggatacataaaacttcatcaagttaatgtcactttttctcctttatttataggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattac

SEQ ID NO: 37268 - DNA, 84648 bp, Homo sapiens; identical to SEQ ID NO: 37267

SEQ ID NO: 37269 - DNA, 84648 bp, Homo sapiens; identical to SEQ ID NO: 37267

SEQ ID NO: 37270 - DNA, 33260 bp, Homo sapiens
gaagctctttcgcggcgctaccgcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacaggtaggcagtcactggggttccctggaagagccctcaactcctgcatcccctcaagccccctgacaagcgggctctagagcccaaatggcagtgaccgcttggggccggcctcacctcgtcacctctagggagcccttcaagcttgggagatagggagcacccacccttcaagctctggcaccgtagggagcacaggcttctctggagatgcagcagttgcattcctccacacatctctccattaccctttctctccttccctcttactcctaggcgttctggctccgtactccaaaaatcagcaatcactgcctaactctaaacgctgggtttactgaaattgatgtgtgtttatatatagtgggtgtgggttttgtttgctttgttttttccttatttttgaaattgggctgtagggctgcactgtccagtaggtagctcttagccacaggtggctattgagcacttgaaatgtgcccgtccgaattgaagtgtgacctaagtgtaaaataccagagttcgaatgcttagtatttattaaaaaaagaacttataatattttattatttgtttattgattatatgctgaaataacatttttgatatcttgggttaaatataagattaaaattcattttatgtgtttctttttactttatgtggccacgagaaaattttaaattgtatgtggtggtgttcacattatatgtttattggaccgcactgctttagaatcaaggatgttttgcttcttattgtttttattttggttttggtttattatgtgttgtcaggaacgttttatatcaaactcaatactagcagttcagtttctcccagtctcagtttctctcacagggaagattaagtagaggaaatgtgtgctatttttgccacaataaattgaaccaaaagactgttaaatggccagaaattgtaaatggctttcacttattggtttgtacaggttttaagggaaggttagcattagtttctgttttcagaagaacattacaaccgcgtgccatagacctgtgactgtgtattagtcaatgggtcactagtcttgtgtattttacttcctacagggatttaactaggcccagcattcagttcttagtgagttaacatccatgattacaacattctcttctcctcctcctatatctaatgtgaaaatacgtcatccccgatgcctgattggccagaagctgtgagtatccagcatcagataaattcctcagcttccgccctgccaaagttactggattttcacctgcctgtggcttttcttcattgtctctcactgtcaggcttcgatggcctaaatggcacaggagatttgggacacttctagagcttgtttccacttcttgtctatcataatccagattcagtgatatacaaggtgtggtgtctgtttactccaggccttatattctgtggagcaagtgctggacaagtgtgtatatgtgtctgtagtcaacttttaagggtggtggttggttagagagggtggatatatgttagaaccagttatgcaaacactatatggaaatgtagcactgatggacccattaggtattgaaaagccaattgatcctcccactttgggtgctgcttctcaggattttgatttatctaagctttgtgcagtttggggaccaagaagtgaagagggagtttccttcccatactcatgaacaattttcatagtctaaaattcttcactgaattgggtaggaaattaattctgtcttcgaggaagccataagaccagcgaaacactctggcatttactgcatcacattcttttctccaatttgttacttaagatcttatcattgcagtatttatgtagtctgagcattagatgaggctatgcagttgactcactggtgtctctttcctcacttataaaatacgaataataaatacatgtgtttctcggactatggagaacaatgtttgcattgttctttgggatgacctgaaagaaaaataagtttatgcaatgttacatgctcttattttaatgactggtgaatcagtctccataacctgacttctatccgatgagtggaccttccccaacaatcttcccaccccttatgagtaatgagtccaattggttgttcaaataccctgtagatgacataacttttctgattaaatttttgagttaattttggtgatgtgactatggaagctgtactttacacctttattttcaaaatgtaaaaatcaatttttaaaatcttttggctttaaaaaaaatttcccactcactcaatcttgccaaaaatctaccttcaagaactttcctactatattctttgatcaagcaatagggtagaaagaatgcaggctttaatgtcccatgattgcaattcaaatctgacgccaaccctgccacttattagtgtgaccattagaaaagtattaatttttctgagccttagtgccctcatttataaagtggagctaatgaaactatgtttagagggtgatcttaagatgctagtgcatataaagtgactgacatgtaatagggtcacagtggaaagaagaatgcctcttaatgggaggaggaaagagtgtgtgaagtgtcactgagacttctgcagcatgcactctctattgttcttagtatccaggaatcttcagggtcatcctctattgttggcctaaatctcttggggcagatatggaactatttccatctagggaataaacatttaattaaaatgggtctcacaaactgatactggtttcctagcagttggagtattaagtgattgaaggacagagaatgagagaagcttttcactttatgccttcttgttactcttgaattttaagacatataaatatatgacctattcaaaaaataaatgacgaagattcttttgctttgtttttttgtttgtttttaaaagtagtcctcttagtctggtctagaatgtctgttgctattcatatttcaacagccattcattcagagcttgggaggtgtaagaactaacttatcatcattacttacctaataggcttctcctggaaacatttctatttctgtcattgctgcagccaacatccagtcactcagggtaaaaaaataatgacatctccaattccttttcattttttttttaaccccctacagtcagtcactacaacgcgggcattctattcacttagtgtttttctttccatttccactgctacctttgtagttttaggttcatgtattaactggtattaaaatctcctaacacctgactttcaaactctaccactttctactaatcctacatcttgttgccaaattgatcatcttaaaattgtattctactgtcattccccaactcaaaaactttcagtcacaccaggtacattggcacacccctgtagtcccagctactcaagaggcagagtagggagggccagtctgggcgacatagcaagatctggtctgttaaaaaaaaaaaaaagtttccagtgtgtattctgtatgttaaaaaaagcaaacaaaccgtcaatcacttagtgactgctaagtgaagtttcaccaccctaaccaggctttaagactgagatatgtccctaacctgtcttattcaccttcactccttttatattacataaaaggagtgcattaaacaattcacaatttcccaactttagccttccctttaatttccttgaaatcatttgatacctacctattggacgtctgatacaattgagcccaggagtttgaggccaccctgaataacatagtgagaccttgtctctacaaaaaaaaaataggcacggttgcatgcctgtggagctagctggctgctggggaggctaaggtgggaggatggcttgaatccaggagtttgaggctatagtgagctgtgatcacaccactgcactctagccagggtgacaaagaaaaatagaaaaaaaaatagttaaatatatatttgttttacatatgaataaacaaatgaacctgggagccagttaccccagcagtctattaatattattgagcatttacctgttctcagtgatcttttcctgagttctggtatataatttataaatattactgacttttatgcagctattgaatctataacatttaaaggttttaatattcaggatatttggaaaatgtttatatggtatgcaaccataaaatttaatataatattctaataaaacatgctcatttgaatacaatgtaaacttaatcatgtaattagttcaagcaccaattgttctaacatagatagactttataaatttaatactatgttctttcccattcctgggataagtacaataataataaacctgtgtttagcacttttacctgtcaatggcttatagaagttagtttggtctctaaacagacctgtggaatatatagggtaggtattatttctattttaaatatgatgaaactaaggtgcagagaagttgcataatttacatgaggtcacatagctaattaatgaaaaaaaatccaggcttagtcttataggcatgataattgtatatttttttattacttgaataattatgcatttttttttcttagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacatagggtaagtattacacagttttagtggccataattgccatttttactattcaaactatattttactttgattttatatttggtcagattatttaggggtatatagatgaatcaaagaataatgaaaaactatcacagggataaaattttaccttttgtgacatttttgtgttgattaaaacactgtggattcaggccctgtactctagattattttgcctgggttaccattcctaacatttataccaaattatagtatttacatgcatattacatgggtagaaatggaagagataaactctgcatactgtaaaatccactgttaagtgatattttattttatattaatagcaatttcaaattcaaatttaatgttattaataccagttcataaagttctgaattagcaggccaaatattaataaattatctctgaataccagatacattagcttttctaataatagacagtggtatcagccatttaccctttttcccaaggtaccagtcactctctctttgattatgaatcccttgagtaaacaaattcaggggtcctcattctcaaaatacatgtattcattattaatattatcatgagtctgtagtttcagtagatctttttaaactacttggtccattttttgagggttggcttaattaaaactgtattaatctacaaaatccaatcaatagatactcataaatgatagtgtaacacaatgccctgtaagtggccaagggaaagtgggtgccactgtcagtcagtcatagagtaacttcctctcagtttcagaatacatcacattctattcatgacttgtgaccatttgaaacaaggatggaataagtaactggtgtcagtctgtaagatttgtataactaccacagagccaagatacaaatattaataaatcacaatttctcttttatttttgttgagaaatgagtataagtagaaatctaacattttcttcccacaccccagcagatactctggcacccaaatttgcagctcgctggaaattctacagcctcctcaagggggattgctaactcctggaaaaaaaatcataaaatatacagtgagcacttctctcccttgtctccatgatcacaagcccccatattatattatgctgcagagaggcctggtaactgctttaaactgcataattttcagaaaaagttaccttttttacagattaaaagattaagtttctctaggggacaggcctctgtgtatgccagagaaagtaatgttccacgtcagctttttgtgtttcttttggtttcctgtattgcattatttagggtgggatttatcttgaagtgccctcccccaacctcacaaaattcattgagaaaactcaagatgtatcataaacagtctaaaatattttgaaccactccccctgccagattgatcactgaactataagctgacgcatttgcagaaaaacttctcaagaacagttttgtactttcagtagaagcagtctttttcatagcatttagaaaaatgtggtatggtgcctggtgattcatcgtggatcttcccaaattgcctgatcttccaaagtatgttcattctcctgggaagccacattaacttttatgttcagaaaacatttattttaagaaaactcagatggatattatttgagtactatgaaaaataaaatgttatgttttaaatgtgtctgttctatacagttttagaaacaaaaatgagtgtcccttccacaaaaacaaaacaaaaggctaattttataagctggaatgcagataaattaattatatgattaaatgtatgataaattaatgcttagtcaataaatacaatatgatcataatttgtaactgatgcagtgattataatgtatgattttatagtaatagaaaaattaaaatacaaattttgaatgaatgccttggtatttactagaaaaaaactgtctgtaattttgtgtgtatttgtgtgtactcaaattacctgattaagacatagaatgaggaggtggatgtgggtgtaagtatatgactctggctatatacagatacaaagtaattgagatttgtgtcagctgaagaaagacccaaaaccatgtagttgcatgaccaatataaactaaaaggaagtattggtgccataaagttatcataattttctctataaagtgaggaaagtaagacacaaaaatgttaaaccctatcaaattggtgctattttataaaaatgagcatatgttttaaccttagtttatactgtatttcctcatggaatatttaactttctaagtgtgaaacatagtgaaatttggactaatttcattttctttcttttcacatatatatgaagaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaaggtaattacttttttaaaaagtttatgtttccttgtccttatagttttaaaaatactttttagttatttcttcgacctagccaatttcatgtctctccttagagatagagactaatgaatagtaatttccatagcccctaatttctatcttctattctccttcttcctactgcagttaggaagttattcctagacagagatagaattatggtacaaaatacaaagccattatgtttcttaattgaattgtcaagatcaccttttttttttactttttattttaaaattattatatatttataggaagttgcaaaggtaataaagaggtttcatgtatccttcacctggtttcccacattgttatatcacacataattatagtataatttcaagaccaggaatttgacattagtacaatgtgtgttcatagtaaccgcaacaatcaaggtacagcactactcataacatcaccacaaagataacactcatcctacctcacccacttcctccctaccacaatctgtacccctaacaaccactaatctgctttccatctctttaattttgtcattttgaaaatgctatataagtggaatcatatagtatgtgatattttgagattggctttgttcacgtcacataatgctcttgtgatccgtctaagttgtgcttgtaacaatagttgttttttattgataagtagtattccacagtataaatgtaccaaagttaaccattcaggaacattttggttctttccattttggggtaattatttacaaagctgctgtgaacaaagctgtacaggtttatgagtgaacataagtcttcattactctgtgataaatgcccaagaatgcaaatgctgggtcatatggtaagggtgtgtttagtttttaaagaaagtatccaactattttccagagtggctgtaccattttacattccaccagcaatgtgtgagagatccagctattccgcatcattttctaaagggattctttggttttcttactgttgagttttgagaattctgtatatgttacagtagtagttcttcatcagatatgtagtttgcaaatatttcctcccagttatagtttatcttttcatccttttaacagggactttcacaaagcaaaatgataataccaaatgcccaccagcatttggtattatcactgttttctgtttagctgttctaatagatgtgtagtgatatctcatcttggtattaatttgcattttcctaactgctaatgatatcgaacacctttttatatgctaatttgccacccatacgtggttttcagtgaaatgtctctcatgtcttaagctcattttctaaagggattctttggttttcttactgttgagttttgagagttctgtatttgttacagtagtagttcttcatcagatatgtagtttgcaaatatttcctcccagttatagtttgtcttttcatccttttaacagggactttcacaaagcaaaaattttaattttgatgaagtccatattttttcttctatggatcatgcttttgctgtcatctctaagcacttttcaccaagttctacttactgaagatttccttttttgttatcttctgtaagttttatagttttatgttacatatgtaatctgtgatccaccttgaattcattttttaataagatgcaggacttaagtgctgaagacactggctattgtgatttcacagctatactatatctaactgagtgtaaataaaaagtagtttttgagtaattaatactaaatgtaactcaccatatttttatgtatcattttgctatacttcttttaataacatgtaatcagaaaattattataaatataaaaaatgttcaaagaaatcagtaatagagaagttgaaacaacagggaaattaaaacaagaaatgtgagagaaaataagtgggaaaaatttttattgaagacactcctctccttagaataaagtggtaggggaaaggagagagaagcaagctgctgcctcagtattgctaagaaaaaaagagactaatctattccatcaattatagaaccatcaagtagaaataccttaatggtcaactagttctctgatacttcactgcaacaatccctgtctcccaaagcagttatcctgtaacagggagtcttaacatccttaattgaataattgtgacattttcttaaatgatcaaccaaaattccttcctggttgcttccacacattgatcctagttcaactttttgtgataaacagaataaatccaatttagttacttcagcaagacagccctttcaatatttgaagatagctatgagctgtctcccaaaccctcacgtacaagtgcattttatccatctccctgataaataccctttagttccttcaactcgttttcttattacatggattttaatccttggtgctatgtagatgcatcattttgtttaaatctcacttaaatgttgatcgtcagaactgaacacaatactatttttggtgcggtttgatgaatgcagactttagtgaaagtgtcatttccttggccctaaatacttaatagttccttaataattcatcagctttccaggggtagtcatatcacatagttcaaattgggcttagtgtcaacaaaaaacccttggaggttctttttgccacgtatcgttgcttaagccacctcttcttaagcaacaaagtacacaaaataatgtactttgcagaatactttctagatatgatcaaattttatcttgttagattggagcaattgcttcagtctcttaagacctttttgaatgttatttctataatccaaaggttttaagtttctctccaagttttgtgtgatgctgaaatttaattagctaattttttgtatctttaagtcatgattaaatatgaaccagtacagagcttgaatcagagctgtatcacatggccataagaaccttcatctgggtcaatatcagtccttttgttaatccgcgcttttggagaacactcattcagtttgtctggaatactcctaaaagtgctattatacagcccatatttcttcattctgtccttaaaaatttttctgaaagtctttgcttaactgcttttctcagctgttctcatgacttagtcatcttggtccttttctgtgaattcaattttaaaattcttgattatttttattttttttcttaaattgactcttttattgtagcaaatgaatgaaaaattcatttattctacccctcctttttgggaatggaggccataattttttttatctcaaattcatctaaatgctaataaaaattatgtattttgttaaaattggtaaaaaatataggaggtaaacaatggaaacaaatgatgtgctgcatggagctcatttcactctgctgaattctaaagtatgcagtaaaatattttaagtaatttcagtgtcttttaggatttcccatactcccttgtcaattaaatattatttctgttcttacattttgtcttacatttttaaaaaataaagtaaaaaataaggaagcttttaaatatttagttataagatactgtataatatgtgcataagatttacaactgaagcaaaactgtacaggacatatcaaaggcacagaatattgtcactgataattctttaggcacccattgtattggacataaatatgttttctttgcaattatactgtttccatgaaatacttcttttagtgatcagcataaaattgtataataattacctttacaattttgagatttagtgtatttcttaatttaaggatgctacctttagggcattattaatacaactgtataaaccagaattgtaaacaatgaccagtgacaattgcatgagatgtgagtagacttggcagctctgtgagatgtaggaagcacatggtatcaagctatatgtcatgaaaagtaaggtgtgcaaggtacacactcattgagaatatcagacaaaaaatgcctctgctcaattttcaaaaattagtctctcttttgaaatttgtaatgttatattaaactttaactcagtatgtattgctcctagagttatttggctcagcagtgtggaatttaattttgtaagaagttgggggaatatacagaaataaaatattaaaatatattacattttctctggtttgatatctaaatacagtgaatatacaaaaagatagttgacttttggactttttaaagaggaaatttcttaattatttgctcttgtcccttacagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatataggtagagtaaagttgcttctgctcagatttaaccttgtctcagacacaaaattagtcaaccagaattttgaagctacattttaaactgtgatttttattcttctctcataattgtggtgaaaataaacttgaggccccacggtgattaatatttttcaaattaaggaaatttaatgatttgctttaagaaacttttacatcctttaagaaattttaaagcatctcttcttatcctatcaatttataatataatagttaaggatttttatcatatgtgacttggaaatgcagagggaaacagtggttcctaacattttagctttaggtttctcaacctgttcaaccttttagcttttgatatctatatatctttttagataaatagacaaactcttaatcacactggggatatttctatttaaagaatccctaatatttgtatatgtgtgaattttttatacaacaaatcaatgggtttgataagatcatattttcatatttcagatgcatattacttataatctcataatgcagtaataagcataacacattgttattgacactggttatttaaccagaataaaaggaagatgattatttacacaggtttaggagatggggacattcacctcatgtataagttactcttatctcttttaatatactaatgaatgcaaaagcagactctctaagtttgctctgaacacattttatagtcctttaaatggctttttgccatctttaataaataatttgttaatgaatcattttaggaatgaatgctatatctctaccagaaaactatatatttaattaaattgcatattccttttcttcaaaagcattttaatttttgttatttctcattaaaaccaaagccagccaatccattttagtggctgcactaaaacaattcatacagtgtcttttacattcacattgtatgaatataagaaactgtccttttatattttgttttctgatatttttaattcattctgaatgatgtactgaggggaggagaaatgtatttatagcttcctaaggtagagatcatgttctacccaacaattcttaaagctggtttgattctataaaaatgggccaataaatctgccagtcattcattttgtgaattttccctttatgttcaatttcaatattctctgtcagggaaaaatgaggaaatattattccttcatttgggtaggaattccctctgtactcctcgctctccctgtaacacaaggtgttagtagtaataaattctatgtgtccattttgaatgcatggttaatgttggggtgtggcaaaattcttatatcctatttaaccatttattctaattataaactctatgcagcttaaccctgtaattgacatctgaagttaaactgtaggcaagatatttctactaccaaagaagatagtgctgagagcagaaaaaaggcagtagaatagagctccatgagacaatttttttcttgttctttgttctttgtgaaaaataatatcatttaattaaagggcatagcttatctgggtgtccaagaattaaatcatccacaaaaagttaatcttgcatgtaacgttaagcttgtattacagtaatttcctaattttttaacttaaagttgattttgtttccaaactacatgagcatttatcatcttcattgtatacagtaattctttgctgccttatcactttgaaaaatggtatcttcagtcagcttttaaaaatagtgctattttagtttattatgcagagttcatttaaaatatgtaacatgtatgttcttatgttaaacagctatgcagttatcacatgggaagtgttatccagaaaacagccttttgaaggtaagtatggtttgacttttttatgctcaataacatcatgttagtaggtcactctcagaactatctaaaaatcatgttattttaaatctgcttattcattttgtggaaaacacactaaaacaaccatttatcagttgtgaatgcatcacatactgcaaaatataccgggttaaggatccagttgtgagtctactatatactggaaaatgtactggattaaggatcagaaaaacccagattttaattcttgttctgacagtaattagctctgtgatcaagtcacaaatctcttgcgtcctcatttttgtcgcctgcataataagaattttaaattactatttccaagttctagtctagctgtaaaattatttatatgataatttaattactaccccctctataaagactagcaaatatcgaagactaatctgtcctttttattccctgaaaatattgtttatttctttattttgaggtttgtgtaggtcagcttgttgtgtaacaaaaaacaacctcggaatctccgtagcttatgaaataaacatttatttctcattcacattaaatattggttgctgtagcccttcttagttctgcaaggtttcgctcagctctgctttacaaatactctgttgaccaaatccaatcacatggtcaagcccaaaattaatgaggtgaggatataaactcattccataggaatcagacaagtctggcaatggtttggggtatatatattccttttacagaaaggggggtaaggcatcattcctaaaatttcaatattcacttattttcttttagttagttttagatgtaagtaatatgcttaatcataatatattactaatgaatgcaatctatttgttttgacagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaagtgagtatatagttttaacctagactctttgaattacagaattagttaatatactgtgaataaaatattccttgaaaaattgtgcaaattagatgactagctagaagttgtttaaattattttctgtcttatcatagcatttatatatgagtaactccttctagagcagaattgagaattcctaacaaaaaagagaaatcgtgtgataggagtaacaatttctttcatatatttaacaaatatgtcttaaacccctaccatgtgctatgtatatactggagtgagccctgggaacagagtagtaaacaagacaaactttctgtagctagttcacattctagttgagaaggcagagtgaaaacaaataaataagcaagatacacaaattgtgacagtcttataaggaaataagcaaggtaatagactaattaagggagggaaacaaaggcctttttttaggggcaaacatttgagctgacatttgaagcttgaaaaagagccagtcattcaaatgctgaagaaagagtattcagccaaacaaaacagcaagcataaaggctctgagcctagaagaggaaaaagttttatattctcaagaaacagtgagaaggcctgtgtggctggaatacagtgagcaaggaaaggaattagatgatattggagagttaagagagaggctattggccatcataaaaaggttagatttttattccaagtgcaatggaaagccattaaagtatcttttgcagggaagtgacatgatctgatagaagtttaggtgaaattcttactgctgtgtggaaagttgattggagaaagacaaaagtggaagcaaagaggctagaaaagacactttcaggaatattctaattaaggtggaaattctgaagacagaagagttacagaattaagatagtatttcagaggtagaatggatcagacatccaaatgtaaatgtaggagaaaatcttcatgacctagggttaggcagaatctttaaatatgacatcaaaaataaataggattcattaaaaaatttataatcagactttgcaaacattggaaacttttccacttcgaaaggtactattgagaaaagagaaagccaggcatttagtgtccacgactttagtcccaggtacttaggaggctgaggcaggaggatcacttgagcccaggagtttgaggatgtgtaatagtgcactgtgatcgtgcctatgaatagctactgcactccaacctgggcaacatagcaagacctcatttccaagaaggaaaaaaaaaagcagagccacagactgggagaaaatatttgcataacatgtatctgctaaagggcttgattctagaatatataaaaaaccctgacaagtcaataataggacatatagccctatttttaaatgagtaaaagatttgaatttcaccaagggagatatacaaatagctaaaaagcacataaaatgatgcttaatattattagtcatttggaaatgcaaattaaaactgcaatgagttaccacttcatacccacaaaatagctataattaaagacagaaaataacaagtgttgacagtgatgtggcagaaccaaaatccgtatacattgttggtgggaatataaaatgatgctgccactttggaaaacggtttggcagtttcttaaaaatgaaagataaatttaccatacaaccaagcaatccactaacaggtaaaccaagagaaatgaaaacatatgttcacacagttgtatgtgattagtgatagcagcattgtttataatagccagcaagtagaaacggtcataattactgctgctactactacaacaatacatgaatctgttgttccaggaagagtccaggatcctaatataaaattgaacatcactaacatattgatagtctggactggttcatctaagaagggaatatacatagcaaagagaggacccatagtaaagctctgaggcattccagcacttagaaattgagaagaggaagaagaaaaaggattaaggaagagaagacagtagagagtgtagtccttgtgtcttggaagtcaaggaggggtatagtcggacatgtttaatctgccaggaggccaaatgagataagcaggattttccaacattgtcatcaccggtaatccaaacaaatggagttttaatagagagatgtaaacagaagactgatgtacatttaaaaaaaatagaaagaagtgaaggcaaatatggaaaattccagcaagatgcttggctctgaacagaagcagaaaaaaatgaggtgatagctaaaggatgatatggggtcaaaattttttcctatggccaggcacagtggcccatgcctgtaatcccagcactttgggagaccaaggcagagggattacttgagttctggagttccagaccagcctaggcaacacagcaacaccttgtctcaacaaaaataaaaataaaaaaaaaataaaaaattagccagacatggttcgttgcctgtaatcccagctacttgggaggctgaggcaggaggattgcttgagcccaaaatgttgaggctgcagtgagccttgattgtgccactgcacttgcactccagcctagctgacaaagcaaaatgctgtttcttaaataaaaaaaaaaaatcctggagaaagatagattactttatctggaaaaaatactctactggaaaaaatgatccagtagagagtcagagattgtcagtgcaagaactgagagagagtatcagaaacagaatgctggagaggtggaggaaatggtattcagaatgcaagtgatactgtttacatttgtatgagtatatggacacttttttctactgtaagagaaatgaggttggagagatggatacaagtacaagaagtttgtagatctggttatagaaccctgaaggaattccctctcatggcttctattttctcagtgtagtatgagagcagatgatcagctagctcaaaggaaacatggaggatgggatgtaagaggctgaaaaagggaagataaagtacaatgcctattacccctgccttccctttctaagttcagaatatattaagaaaaagccgaggaagaaagatagatgttgatcagaatatcagtttcattactgataaagctaattggagaatgtacctttagatctgcagccaaatgggcttagtagcattttacccctacagttgatagctttaccagcccaccacaggcctcaccctgcttctacatagggaagcagaaaatgtatgcattctttaggcaagctgacttttaaaagaaggagaaaactgcaaaggtaccaaataagcatgcttagtttttctccaagtttaataaatgaggtaagtctgaggggcagaaaggagctggaagaattcctcctatacttctctttcctgaggattgaactggaaatgtcatcttcctgttggaaacatgaagaaaaggacttaagtgtctcctccaacagtacgagataattatgtaagacagcaattctcaaacttagatctcaagactcttcaaaattattgaggacttcaaagagcttttgtatgtgtgggtaatatctattagcatttactgtattagaaattaaaaccaaggaattttaaaatgtaggaatatacaagaacacattccattatctgttgaagcagtgatcttatcacaccttatttatgggcctctggataaatccactatatacttgtttggggatgacagtgaacagggaaaataatgtcttagtacttgttattttgaatatagttttgacttcatgaaccctcaggaaccacccccgccaggggtccctggaccacactttaagaaccacttatctatgagaacagaatagtagatgtatttaggaagcaaaataggattgctgagaagtggtatttagtgtctagtttgggccgttaatttagagaaaccagcgaccccacttctggccaagatggagtaactggggccaatttaccctcctgcctgaaacaaccaaaaaacctagacaaaatatgtgaaactggtttttaagacactaaatatcaggaaacaaagagcagcaatctctgatggatgggaaacaaatgaagtgagccttccgattgcccagcttcctgccttgagagtttctagatgcagcatggggagaggaaacaggtggaacccagtggacactcagggtcaaggaaacagggatgacagtgtgggtagaccaaggcagacagacttcataggacattgcaccagaagggaaaaggtacacagagtgagaaccccagagatttcagagggttcctctcaagtattcagtggagcactgatcagtacagggtgaagtcagtaagccaaaagccaaaatcttgagcataggagaaaggagaagtttgcagagaagtaagtattgcctaatggcatgaactttagaggatctagaattttcacagaaagaagaaattacgatttggaaatggcaaagagaggacaacagagatatatacccttcctcatggctctggaaagaaagaaacaaaatgtgaacccattaccttagcaacttttgatttgtaaatataatgctgatgaacaatggatataagtattgaatgaaaaatacaatgcattatttttctagtaataagaacttagagtttatttttaaactgtcttaactgaaatggcctataaacatatccagctttgtatctaatagtacagtgtgagtgtgtgtgtgtgtgtgtgtgtttaatttatcacatttcttacaaagtactgttgtctgccttagacatgtttcatttatagccattgggatgctactggttttgttgttattgttaggttttgaactttgtttttaaatggaagtacaacttttttttcctaggatgactgtttcctattttcagtgggaaggtaccatcattgatttataaacacactactgcctatacagcctgtcagttttattttaaggctctggtgtatattggaatgttgaaaagcagattctgggaacctgaaagggaaaggaagaaaaaaaaatcaataataaggaaagtttaagtgtattcagtaaagaaattctgtcaataggaccaaatggaagaacatgaaattacaaagggatctctagataccagagtaagcacaagatgcctacttttggacaaacctactgaaaagaaatgaaaagttcacaatgaaagaaattttaataaaaaaataaaggaagcttgaaaaactaaaagcaagcaatatttttcctttttttaaaaaaaatataggttaactgaattaaggaaaagaggaagatcagtaaacctttgttgaaaaagtaactagagagtatatattctgaaaatggatttaactgttcaattaatatacatattaaatggcaaagtaacacagtagcagagaggaatcatataataaagattatttttttcaaaagcctatcaaagtataatttacttaccataaaatttatctatacattcattgactttttagtattaataattttacagtttgcaaccattactataatccaattttcaagtatttccatcaccccctacaaaatccctcctaactatttgcagtcactgcctgttctcaccactaaccctaggtaaccagtaatctattctctgtctttctagatttgccttttctggatatttcatataaatggaatgataacaatgtgtggtccttttgcatctggctcttttcacacttagcgtaatgtttctcaggttcatccaggtttcggcatgaatcatagttcagtaatttattgttgaataatacatcatcatatggatgtatcccattttgttgatccattggccagttgatgaacattttgattgtttctacttgttgcctctgtgaataatgctgctatgactgttcacatacaagtctgtgaacatatgttttcatttctcttggttaattatctgtgaatagaattgctgggttatatgataaatttatctttaatttttaagaaactgcaagctgttttccaaagtagctgcattatcttattcccaccagcaatgtatgaggttttcattttctccacgtcactgtcaacacttcttattttccttttaattatattttagtgagtatggagtgatatctcattgcagttttaaagtgccttttcttatgatgttaagcatcttttcatgtgcttcttgaagacatttgtatatctcctttagtgaaattcaaatcttttacttgttttttaattttgctatttttcctgttattgtcatgggtctgtatatattgtagatacaaaccctttagcagatacatgatgtggaaatatagtgtgcaaggctgcagcttatcttattttttcttaatactgtcttgaagtgcaaaagtgttcaaattttttgaagtccaatttttaggcggtttttgggttttttttttttttttttttttgagatggagtcttgctctgttgcccaggctggagtgcagtggcacaatcttggctcactgcaagcttcacctcctgggttcacaccattcttctgcctcagcctcccgagtagctgggactgcaggtgcccgccaccacgcccagctaattttctttttttgtatttttagtagagacggggtttcactgtgttagccaggatggtctcaatctcctgacctggtgatctgtccgcctcggcctcccaaagtgctgggattacaggtgtgagccaccatgcctggcccaattttcaagttttttaatggatttcatttttgatgtcatatctaagaactctgcctaacccaagatcatgaggattttctcctatgtttacatttaggtgtgtggttcatttcaagttagtttttatgtgtagtgtgatataagtatctaaatttatctgtttccaggtgtatatccaactgttttagcatcatttattgaaaaggctatgctatcatttccccattgaattggcttagcacatttgtccaaaaacaggtgtttttagattctcaacactattccattgttgcttatgtctatctttatgtcagtaataaaagctcgtaaaacagctgaatgtcatcactttggggaaaaactgacttgaggccttgtacattaaatgttagcatttcactttaatacttagaagcaatctgaactcaacctgtatttttttctcttatgtagaatgtttaatagaacttgaaccagttttgagaacatttgaagagataacttttcttgaagctgttattcagctaaagaaaacaaaggtaagttgctaaatgaaatgctggaaattagaaatttaaacaactatataatattcatggagatttttagttaagtgtagtttttaatatatatactttacacagatataagctacagttttggagtgagaaaatttaccagagactatgaatactacttttcctttgtcaccaaaagcttttctatttcattcaaatggccaccttcagattttaaagacatttccaggaccaggcgtggtgactcacacctgtaatcccagcactttgaaggccaaggcgagtgaatcacttgagcccaggagttcgagaccagctgggccacatagcaagaccccacctttatttaaaacgtaaaaaaaaaaaaaaagacatttccagaacccttatatatcagacataaatttaaaaatgtataatcacagccagttgtgtacaatgaatgcactgagccattagaggtgtttgttttttaatgtacatttattttcccaaagttgtaatgcctagagaataatagatgtctgggttctcgcacttctctttttatttaatgtacatttttttctgagattcctcgccaagtttagctgtagaatttttattaaatttgagaccaaagtgtgtttgtggtttgttttttcatttttcctctcaaacacttcatgttttatagaccaaggtagcagtaacagtttatatgaattacctaggagagttgtattaaatactcagtctgattcttgtgggtcggaacaatttaagggacctattactgcaggggtttttttttttttaatattactcaaaattgtttaaaaagcaaccacagttcattagggcaagtgctaaactatgcttactttgccctaatgaactgtggtttgttaggggatataggtttcattaaattgtacttaatatatgatataaaaaccagcagttagccaaactcttggggtgtgaacaagcaacatctacaatttttatcacaaaatgacattgcttgcctgccccttgtgggttgctggatctagtgacataacccttggtttcaaagggaaatgcataaaggaaggaactaaagaggaactgtgttttcattcttttaataacttttcactggctccaccacttctgagtaggtagtgttttccagaaaataccaatttctctcttccttaatagattgaattttttttttttttttttttttagtttttaaagacagggtctccctctgtcgcccaggctggagtgccatgacaggatcatagctcactgcaacctcgaagtgctgggctcaagcagtcctcccacctcagcatctccaattgcttgaaactacaggcgtgggctaccacactcagctactttttaagttgccatattttttccactcaggattgttcttttttttaaaaaaaatcttgtatcaattctgtgatacttatagggcaagaatatcatctgatttttgtagataagataactaaggtacagtagtcttcccttatgcatgggagatacattccaagaccctggtcaatgcctgaaaccatgggtagcactgaaccctatgtatactgtacatacatacctatcatacatacatacttacttttcccatgcatatatacctatgataaggtttaatttataagataggcacagtaatatattaacaataaccgataataaagtagaacaattctaacaatattctggcatcactattcttgcactttgggccattagtagtaagagttgacttaattagtaataagagttatttgaacagcctaggcaatgtggcaaaaaaacataacaaaacaaaacaaaaaatatagctgggtgtggtggcacatgcctgtagtcgtagctactgagggctgagataggaggatcacttgaacccaggaggtagaggctatagtgagctggcactccagccagggtgacagagtgagaccctgtctcaaaaaaaaaagttacttgagtacaagcactgtgatcctgacagttgttctggtactaacagggtggtagcttatacagcatggatatgctggacaaagggatgattcacatcctgggtggaatggagctgtaggttcatcatactacttagaactgcatgtgacttaaaacttatgaattgtttatttctagaattttacatttaatattttcaaaccacagttgagcaagggtaatggaaactgcggaaagtgaaaccaagataagagggggactaccgtatagggaagttagtcacttatgtacatctcacacagtaagctaatgtcagggacaacagtagaacacgaattaaataagattcttcataaagaaatttctgagctaggtgtgatggtacatgcctatagtcccagttactctgaaagctgaagcaggaggatctcttgagcccaggagttccagtccaacctgggcaacataccaagaccctgtctcttaagaaaaaaaaaaaaaaaattctgaaagccaaaattagtagggaaatttgttttgagtttcctacattttttcaactcttggaatcagctcccgtaatttatgttttcctaggtaattggcttctaaatcttgaataataaacactgaataaacatagtttttcttcagttgttcatttcttcttagggacagattcactaattcacaagtaatttgaattatcataactgatcagttatgaaaaactgttactaattcaaggatattgcattatcagaaatgttttggcaaattttataagcagaggaaaacctcacataacagagataaaaccaaaaactcattttaaagggtcatataacaatatgtttatagatgtttattgaactgctgtgtataacgccctgtgctaggtacattatatacacagatgaataagagtaatttccttctgaagttccttagccatgtaaatggagtatgcagtcataaatgtgcataatggatggctgggtgtgaattcaccattttccaaattctgaagagtagttgacattatgatggtctggggaagaaaatgattgataggtttgtatttaaatcactgagtagtgatggaaactaatccaagcctagcttatatagacaggaataaaccacttaattttaacacaaaagaatagtatttaagtaaatcatctactcagcagctaccatttattgaatgcttacaagtaatgtttgggcctttttgcatatattacttttcattttcctcacagtaatccttcaaaataggaatttttatctccagtgtacagataagtaaactgagattaaatctaatgtctcacgtcaaacagatgtgggtctctaaatcacatctgattggctccatggccctgccattccattattgacactctacctcctttacttagtccaagcctcaatctcttaactataaaatgaaaataataatagtacttacaggcacagtgcctaaaatgtggtaaatacttaactatagatagacatacaatcacactcccaaaaattcccaaaaatttattaagtacctagtttataccagatatttcatatttataagctcaatctctagaaccatcctgcatgtaggtaattgttagatttcgaggatgaagctctgagacactgagagaaggtaaccaattaatatgagccaggattcaaagtctgtgtttctaaagttatttcccgttctacactgtcttttccttcagttatatgttatattctcaactctttatattttctttccatgtattttgtacaaacatataaaatgtgttagattgtattttacttctataatttcctaatcatctccagttaaagtgtatatatatttatgtattcattacagttacagagtgtttcaagtgccattcacctatgtgacaagaagaaaatggaattatctctgaacatacctgtaaatcatggtccacaagaggtaaaaaaaaaaaaaaaaaaaaaaaggttatattaaactcaaaatgtgagaagaatttgaaaaaatcatttggtctaagcccttcttttatagaaggaaaactaaagcccagggagcttttaggatttgtttggtagctcatgtcaatctccaacttgaaacccagctgtactgattctcagttcattgttcatcccatcaaatcacaattattgcttctttgtttgacattgagttctgtccctgtcattgttttatacaataaatgatatcccagggtattatgtaggcaaatcattgattacagttttaacactgtatttatgctaccttgttcttacctcttataataattaatgagaggaaaacattgctgcctaggaagaaagatctctttagtagcattcaatcagacttatattagtctgaattagtaatttcttttaagaatgtatatgtatgttcattttacagaattagaaaagtaacatagattgagcatccctaatccaaaaatccaaagccctccacagtccaaaactttgaacaccaacatgatgccacaagtggaaaattccacacctgtgttagtctgtttatcgttgctataatgaaatacctaagagtaggtaatttataaagaaaagaggtttatttggctcacaattctggtagccagaaagtccaggattgggcagctgcatctgatgaggaccttaggccgcttgcactcatgttggaaagtagaaggggagcgagctatgcagagaaatcacatggtgagacaggatgcaggagagtgaaaatgaggaagtcaggttctttaacagcttgctctctcaggaatccactcaccacttctagaatggcaccaagctattcatgagggatcttcccccatgacccaaacacctcccattaagccccacctcccaacaccaccacattggggatcaaatttcaatgtgagatttagtggggacaaacaaaccatatcaaaccatagcaacatctgacctcatatgataggtcgcagtcaaaacattgtttcatgggtggacacgatggctcaagtctgtgatcccagaactttgggaggccaaggtgggtggatcacttgaggtcaggagttcgagaccagcctggccaacatgacaaaaccccatctctactaaacatataaaaattagctgggcatggtggcgcatgcctgtaatcccagctactcggggggttgaggcaggagaattgcttgaacaagccaagatcgcaccactgcagtccaccctgggcgactccacctcaaaaaaaaaaactttgtttcaggtataaaattattttaaaatattgaattaagttaccttcaggctgtgtgtataaggtgtatatgaaacataaatgaattttatatttagacttgggtcccaaccccaagatatctcgttatatatatacaaatattccaaaatctgaaaaaaatccaaaattccaaacacttctggttccaagcatttcagataagggatattaaacctgtagtatctttaaaacgaaccttaaagcatagtatatcacatttttaatcacttgatgtacagtatttcatttgatctttgaggccattcatgcatatttttagatagacagtgcggataatagagccaaaaacctgagagccagagaggttaaataccttattgaaagttagctagtgattccatgacagagctaggagtaaaattctccattactttttccatgttttcctgtgcctccatgtggaaggaacctgaggtgctgagaacaggcatttctaaatctgtaggagaccagacttgcagataccaaatttctcattcactattctagctactggctgcagcatctgagatcgtgtagaaaatactgaaaaaataattatttctaatgtttcattattcccctatttcgcccatttgtgttaattaagaaaataagtttatctttgttggttattttatagatgtatgtgtttctttaattttgtaaagtataatttttagtagttttgtaggttgggcacaatggctcacacctgtaattccagcactttgtgtggccaaggctggtggatcacttgatcgcaggagtttgagaccagcctgggcaacgtagcgaaaccccatttctacgaaagatacaaaatttagcatggtatggtggtgtgcacctataatcccagctattaaggaggctgagatgggaggttcacctgagttcaggagggtggggctgcagtgagcctaggttgtgccactgcactccagactgggcaacagagtgagaccctgtctgaaaaaaaaaaattagtagtttttatcttcatttgtgataagccacaaacaagaactatttagaaattaaagctcgataatttttattaacctaaaccctttattttttatttactttaggaatcatgtggatcctctcagctccatgaaaatagtggttctcctgaaacttcaaggtccctgccagctcctcaagacaatgattttttatctagtatgtagattttccaatcattatttacttgcaagttttccattttctttcaagatcaaatttttgcaagcagtcatgatttctatggaactttaatttgcatatataactcattttgtaaagcgacagagtctaaagataggaaaatagtagtgtgatattcaacaaatacatttaagttttaaggcattatgtttggccaggcgcagtggttcacacctataatcccagcatgttgggtggccaaggtgggcagatcacctgaggtcaggagttcgagaccagcctggccaacatggtgaaaccccatctctactaaaaatacaaaaattagccaggcatggtggtgggcacctgtagtctcagctacttcggaggctgaggcggaaagatcgcttgaacctgggagggaggttgcagtgagccgagattgcaccaccacactccatcctgggcgacagagtgagactctgtgtcaaaaaataaattttaaaaaacaggcattatgttagacactgccagaaaatgtccgcaaaaaaatctcttacaagaaaaaggagaaatgtttctaaataactattatatgagatagtgatataagagagacgtggatctagagctatggtagtacagtggaagagtaacactgtacaaaggactttcacaacaaccttgtgagagaaatgtcctcattttacacatttaaggactctggatcacatagctagtagctggcacatctaagacttttgataaatattatcatgtcactctactctaccatgttgtcatcatgaaattatttctggctgaaggctggatctgtaattacaaaggataggcattccaggcaaaaggaacaacatacaggtacagaagcaagaaaatacagagaacagtgagtaatttggtttagctagtaaagaaggtgaatgaaagaagtaagagctaagtagattggagtcatatcatcaagaattctaactttcagctgaactatttggacttttttacttgagtaggaagcaactattgcaattttttgagcaagggagtgacataaaattttttactttggggagattcattctggctggaatgtgtaggatattttgaaaggaaaaggaaacttgagatggggagatcagttaggagactattactgtagtacccgtgagagattattaagaaccgatacagaatgaaagaaaggaggggtggtatgtgagatgttatagacaactagatgataggactttgtaacttttcacttagaggagcgatgagagaaaaaagaggtaaagccaaataaattgttaagcctggggactgggagaacattggtgccattaaaagaaatagaagttaaaacaggctgcatgcggtggctcacacctgtaatcccagcattttgcaaggccaaggtgggcaaatcacttgaggccaggagttcaagaccagcctggccaacatgccaaaaccccatctctactaaaaatacaaaaaaattagcgggtatggtggtgcacacctgtaatcccagctcctcaggaggctgaggcacaagaatcacttgaacctgggaggcaggggttgcagtgagctgagattgcgccactgcactccatcctgagtgacagagcaagattctatctcaattaaaaaaaaaaaaagttaaaacaagttttagagttaagacggataattatacttttaatgtttttgtttttgtttttaatttgaggtactaggagcacacaaagggttgatggccagagggcttttgaaaatataacactaaggttcatggctgagtgtagtggctcacacctgtaatcctagaactttgggaggctgagacaggtggatcacctgaggtcacgagttcaagaccagcctggccaacatggtgaaattccatctctactaaaaatacagaaattagccagttgtggtagcatgcaactgtaatcccagctacttaagaggctgaggcaggagaatcgcttgaacctgagaggtggaggttgcagtgagctgagatcgcaaccattgcactccagcctgggtggcaaaagcaaaactccatctaagaaagagagagagacagagagagagagagagggagggagggaggcagggagggaggaaggaaggaaggaaagaaggaaggaaggaaatataagacgaaagttcaatgaagacagaaaatgtaattgcgtggatttgggaatagaggggatgattaagtccctgaggctcagtgggattgccagaagagaaactagaaagacagacatcatatatagatttagagaacatacttaaacttcagaaggagtaagaagacacacaggaaaaatatgggactatgtaaagaagtaaaattctatgatttataatttacacagaacagacaatttctgacagaaattgtagtgaaagcattccatataaacccttttttgttttaagaaatatctacttgcagaattaggtttctgaaccagccttaatattagtggaaactaaagacattggagcctaccttctgtctgctcagatgttgacatgttagccaataggaatttctaaggagtattctacttctaatgaagatgttgtattttgtaggaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcaggtaaatatttactgtgaaacaccttgtaagtgatgccattgaccttacatatctgtgttcagtggatttaccatacaatgaggtttgtctttatttcctcaatatgataaatacataccttcttaagtaggaaaacaaatcccaggagatgggaatgatgacatggcccaaatggtattctatgaacatctaaatagggaggcagtgctaagaggaggtattaacatattactaatggtaaagttatttttgtttatttaaaaaatttgcaggtatcttttatatttgaaataaaatggacatcaaacaaaactgaacaaatcccagaagatggaaatgatgacataaagtggtttttgccccgtgatttataccataggaaaaggcaatgccttttctggggagtgagggggagataacccaaatctctgaatgtttcctgaaaaatgacaccattccccaaagtgttggtgttccatattggcacaatcataggaaaattatgttttatgctttatttatttttcatggaattttacttattgctatgtatctgtcctcaccttttaaattattcattccttgttctttttcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggcttcctgtccccatttttaacctcagccttccctactgtcaccaacaaccaagctaaataaagtcaacagcctgatgtgt

SEQ ID NO: 37271 - DNA, 1897 bp, Homo sapiens
acttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaaca

SEQ ID NO: 37272 - DNA, 11023 bp, Homo sapiens
ggcagtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggtaggtcgggagtggcaaatgccggcgtagcagctgcccgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcatttattggttccccttggagctggacttggtcgtaggccgtccacgggcaggggctccggccgcaactgcagcgggggtttctgcatccaatccccctgccccccgcccagccccgcacccactgcatccactagcgccgcacccgggctgcctgcagcgcagcgtttcggcctgggagccgggcggggccgggcactagacccccccccccggcccgcccctccccaccccgcttctccgccggcgcgaaggtggcaggtcgggcgggcagtggagaatgaatgggctggagctggccggtggcgcacattgttccggccgggtgttgaggggcgcagtcagcgcccgccacctccccactttggccggccctgctgggcgccctccctcggtcgctctcccctccttcttcccggggggcgcggcgcgggcgtgggctgggaaggaaggagccggggaagggtggggttgggggcaggaaggcgaggggttgggggcggagagggcggaagcggcggccgggccgccctgcgcccgggcggggccctgcggtgtggccgtggcttgttcctgccgctttcgcaccctgcggccccccacccagtgcagcagtgcgggcgggcgtgagcctcggtgcaccaggaggcacttcccgcgggaggcgctgggctcgcgctaattggggcggggggggggggcggcgggggaggagggaactggcgcgcggcttggtttccattagagacgcaaagtttctgctccgggaggaggcggcggcgccgcgggctcgtcgcctgggggagcagaagcgggtgggaggtgcgggtggccttggcctcagccctggtgcgcgggggccgggggtggtgaccctcctggccgaggaggggcggcgtccagacgcccgctcgggggccgccttcccccccacgcctgcccccgggcacgcgccctgcccggtccctcgccccgcgccacttccagtccgcagagagatgccctccacgtttctgctttctctgcagcctctagattgccagatgcgactgtgcgcctcgctgggtgtgttttccacagccccttcctcctcggcgtgcagggctgacatcaccgactgcgtttctggtttggcgggtggggagatggttccccgcagggttctggtacacctttgcccccagggctagcgccatttgggggaggaggttttcgttgtcgagaaagttggatgctcctggtaacccctctaacaagagagttctgtagcgaggtgggactgttctccccataaggtgacagtttctcttgcgaggtgtggcagcgcttcctgttgtacaagacagatgttgccttggcgttacgtaaatcatcgtgtctccgtcatttaaagaaagccaatttttagtgattgaggtagaaagaaagatccgtttataatttgtaaaaacaaattttcacccagaatcaatatattggaacaccattcctactgttaaagttttcacttaagagtataaacttcatcagctttctattaggacttattttgtaattggcttcttaggcatccttctttaaaagagaaatccacgttagctctccttgaggtctcgagttccctcggctggaggcacaggttcagtggagaccaaataatgcaggtgaattaccttcgtggccattactgcctccaacgaagtgtgtttattaagaacagttcttatgtcattcttaaggtaggtagggttaatactctccagcaaatttagtagatactctttgccagaaaagagaggagtatatatagtttgataattattgtgtagttttctgtgtacttaatttttgcagttttgtaacacttcatttgtaagatggtaccattttttcctggcttctgaatcataggatagtttgacccagggcattagccattgtaatggtaggcttttaacaaataactgcctaatttaaaggattggaaagcatttgttacatggaaatgaagttggtggcgtacccagttgctgtatctttattttttctacttaattatttctcataaaatggatataaaagcctgttaatccaacccaatgccattatgtaacgccagtttggagatttcgagggcctggagcagtgcgcaaggtgcgctgaaagcctgcccctggatgagatccttatcctggctgtgatggcagtggcagtgggctgggtcccttgttgagtggaaagggggactgcggtgtccatggtgcagtaggtggcgctcttctgtcttagagcctgccgccactgcagctggtgccaaggggccttctgccactagaggtgccatttttcacatgatgaacttagcctagttagatcgcagagcaagctgtaagccatgggcccagaaaagaaaacttgaagtgagcagatgttgtcacttccttgtaatcctttgttaaaatagcataaggagttttctttattctatttactttcattaaatgaccgtgctacaggtttcaaaggattttaagattgatttttgaaagatcacaatattaaaagtataactggaaaacctatgttgaaatcaaccaaacatgtcgtggactgaatgataaccttttctttcttcatataggctgatcagctgaccgaagaacagattgctggtaagttgacaactccaaggagtccccagaaggccagaactaggcactgactcagttttggtgactcctctgttcctccccgctacagtctgggcagttttctaagaatttatttaaataagaacagtaagcagaaacactgaggtcagatgttattcttgccagtactttatagatgaggtgaaaggaagtaaaactaaggatgcccacatgttaaactctggagaatttgaccatgtttcacaatgtgcaaagtttgcgtatgattaattgtactgagcctgctactcagcggtttagtttacaattcttatgccatgggtctttcagtaatctgccacgaaagcttgtgctcgctatcctaaaataaatggaaatgggtgaatatgagtgttaggaccactgtagtaattgggaagaaagttacattagttaaactctgttgcccaggctggtctctaactcctgggctcaagcaatcctcctgcctcagcctcctgagtagctgggactacaggcatgtgccaccacgtctggcagattttagctttttaatattcctggaggacttgttttgagactgtttctcgttaggaaaccaggaatgcttctgaaatattctaaaagtcatgtggagagagtttacctgggaatgtacatttctagtaaccattttatttgttatgaaacaagggattcttatggctttagaaatgtaacaggaagggatttgaagggggcacatggaccaatcttgtcagattggatttagtcccttgaacctgggaggcaggggttgtagtgagctgagattgcaccactgcactccaatctcggtgacagagcgagactccattgtttaaaaaaaaaaaaaaagattggatttaggactaatttaagcatgttccagcttagccgccttgaaacctttgggaatattgtggtgtgtggcactgtttattgggagcagtgtttgctttatgggctgctgtatgaaggccagtccaacaggactattgtggtcattatttcagtagataaagaccagacttctgatacgttgcacaacttgaatggctggctttggcaagcccccggcaagtgtgtattgtgactgggttggataaagacattgattctaacgggtcaacttttgttttcagaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaagagctttaaaaccatgaatgagggccattgttgtgtaattcaagttcagacatgttacaggattgtctttcaggtccccagagcaaagcaaatgtgcaaagatcctttctgtggttgccccagggccattgacaattaaaatagaagatgatgggccttgcgtccatcctgcttagtgtctagaatgttttctgcatgggatcactattgttttcttcctgcttggtgcgacctagagctcaaatctatttttttttttttttttggagacggagtctcgccctgtcgcccaggctggagtggcactggcgcgatctcggctcactgcaacctctgcctcttgggttccagcgattctcctgcgtcagccttctgagtagctggaattacaggcgtgtgtcgccacgcccagttagtgttttgtatctttagtagagatggggtttcaccatgttggccaggctggtctcaaactcctgacctcgtgatccgccctccccggcctcccaaagtgctgggattacaggcgtgaaccactgctcctggccgagctcaaagcttttatcaactggcccatgagtctgcactgagtcttgaggggggaggtgaaattaaatagccatagaaagtgctttttaacaaacttactgtgtttaaagaggaggaggaacccccagatgaagtaggtgacgagcactcttagaagttaccataaaagtgagtacagtgtgagctgtagatgtgtttgctgcagaggagcatgtgaggtttggaggcggatgtgtggtgactccaggggatagatttgcagaacctaacggaaagggaagctgtaaggtgcagggccagagggaaccagcagtaaccctgatagcggtctgtcatctgttcctctcgactctacagcagcggacaacagaactttgattgctgatttccatcagtaagcaggctttgaagcacacttccccacccctaaaaaaaaaccacgtattttggtaaatcctatatatattctaatgtactgtatgacagtatagaacatgatttttaaaagatgagttgggaggagaaaaggataaaagaaaaaataaaagaagcattaagaataaacaattcggatctagattttactttctagatgattgactcgagggtggtgtagtaaaatcgcttgtctggtcacaaacatttggcagcagagcttttgattaggttctttgacaaagccttcagcacgttagagtggttttcactaatagtgttttggaaagaaaaggttgtccatagttctctagtttgctaagatgatcagctacccaggaacgtggagtaacttcctcttgtttgtgggagccccgggaatctgtgcctggggaggggagaagtctgttaggctcttggattgtgtggaagaaggagaagttgtgccaggctacagaatcctgtgtttgcactgagaaaacaggatggtacctgaccttctctgcatggctgtgagatagcttaaaataatttcttttgtttttgatgaatatgaacaatatcttaaaatttttgaggctaaaaaagtcttgaagggatccctgaggtattttctttgaaaggtactggtgaaaatgagtaacttaacctaagggtttttctttctaattttatttccatttagttcaatgacactgttagtctggagtgcttgtctttgggggtattcatctcttagttttaaagaggagttgtttggagtactggccgtagaacagattgttctgacagttccctaagtgttactagtctgagctgtgagaatgctcctgagcttttcccttaatgggaaataaagatactgagttggaagaaaacaggtggctaaccatcatagcgtggccaagaaatgatcctggagaagacttggtaagacttcatggcccatgcatggcataacagaatcaatgttcctctctcataatcttttctcctctgaaacactttatacacttaacctgcagctcagttctaggccttttttgtgttactgctgtcactaaccaaggcagagtgagacctgagtgatttccctaactcagggatggcagtcgggggcgctttcttccctcggagtggaaagattcagcctgcggagtggtgtatgctatttttctcttgaactgtacagcccttcatgacccttccatgggcttgaatccagatgtgcagtttcctttgtataattaaatactatcctgggcactgatgatgagtttgaaattatgtgaaattgccctgtgaagtgtttgaacgttttagacctgcagatgattgaacctagtaagatagtctgcccctttgtcctagtacatgtttaccgttccgtacagtggttctgaaatgattactgcagagcagcgttaatggagtgcttactttacatgagctttttgttttttaattcgaggtaatggcaccattgacttccccgaatttttgactatgatggctagaaaaatgaaagatacagatagtgaagaagaaatccgtgaggcattccgagtctttgacaaggtaatccagcatctacatagcagatggtacttaagtatggcttcttccgctttcacttctaaaagctataataatgttatagacagaagacttaaatctaactgcctgagcctctgatctcactttcaaaaatcctccttatggtaaccgtatcaggggagggtaggcataataaataggaattttggaccatgtttcttgactgttactttgaattgttgtgagcttttgcaaatcctgttttctgcattagctgtttgcatgtatttagtaggttagaggtgggaactagagatcagagaattgtttatggcagcagagttagcagtaacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaaggtaaaactaaattctctgagctcagtgtttcatagtcttacctttagatctgtaagcaagccaactgcttcactagacagcctttgactttattttatgtacagtaaagatgttgtgttcattaaagctgttttcaaagataaccaaaagttactattatatttgtcttttcagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtctttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccagggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagc

SEQ ID NO: 37273 - DNA, 292446 bp, Homo sapiens
ctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcggtatcaaatctattgggagggaggggaacgtgtccgggcaggcgctggggtcgggtggcaaaactggggtgaatttgtagaatttgggaaagggtcattgacatcttaaaataggtggtcgtttggagcaagaatgctcgaaaggggtgagggtaggttaggctctctagtgctgggggaaaacaaaatgtggaaggattggtggaaaccagacctttaagatttatattatgatttgagatttatatgattccatctaggccagatttaaaaaaatatttgacatccccatttctggaatgtaggagataaaggcactaagacgaaggaaatggtagttgtgctgtgtgtattacactgaagaacaaatatttgcaggataaaattaatttggacatttggctggacactgctcggtatgggtccagtttagttggacctcgagcagaagactggctgttgccctgttgtgtaccacaatctttggtttccagtgctgtgttgaaaagagcactaggcttagaatcagaaaactcaggcttaagtgttgactcttccactcataatgtttgaacgagacatgtcacttaaaattctgtctcagattcctcatcactgaaatggagctaataatgtgcactttacaagattgttcttaggattatatatcacgaaagtgtttccaagctctaaaattctacataaatgtaaaatgcatgttgcttgtaccattggttttgggactagtcttataaatttcttaatgatatatggtgttttatctccttcctagaagagatggaaagattctgaagggcagaaacagtttttcttttgtatcttccttccatatgacaaaaagctaagcatgcagaagggactcgatacatgcttgatgaatgaatgaaatgtgaaagaccgtacagtttgagaatcatactgagaataataaatcagaagagggagagagatctcaaaattaaatatttgttggatatatacatgtaaatacatatgtccagtcttctttaagttcaaaaaaatacatatataatgtgtgtatatttatctatgcagtatattatatataaatagagagtgggagagagacctcgagaatggaatacatccctttttcttgggaagaagcaatgtggtgtttttctgttcccaattaaaccactcttctataagtatatcatttaggtgatagaagtaacattgtttaaattaacattcaagttatgaacacacactggtaaaaattctcttaggaatgccttaagacagcaaaggaaaaatttttacctgttggcaatatttattttaaaaagccatataccaaagtataaaatcattactatggtgaatggcgttatataacttagaataaagattttacaattttttttcagtttcagtctttgctaactttagtagatgctaatcagtatactttagctgttaaaggtgattgtactttttcttcttttaaatcaagatttttctttgaagagaaaatcgaacattagaggcactattgacagcaaatggaaacagggattcaagagctaatatatctcttctcttacatttctattcttttgtattgccttatttaggaaattttttattttcttatttgagaactatgaaagaatcccagagtagaaatcagcttaagggaatagtgaaagaaatttaaataatcgattgctcaagggtataattattttgattgctcagaattttgctctatatgtttaatgtgttaaatgtaattaactgccagccaaataatgcttattgcatttaagatgtgaaaaatgtccttttctaatgcagtattttttattgtctcacaatgatctaagtgcctagtacataataggtactcaacgtgtttctagtcaatgatttaatgatctgacaagttaattttggacgaacattcagaaattgagtattttttagtgggcacataaattacttctctaccttattaggtagttaaatctttataaagctttaagagaaatttttgtgtgtatgtggagaaatctgtctttaattatcttttaattagaaaactcattatttcacttccttgcaaattctaaatttttaatgttaatcatgatacttaattcatcttaggtaatattattttccttattttaatttttcaaatgagtgcttaccctgatataaaagatttataaggttttaagacattttacttgttgtgcaaataacctggtttggttcaatactgaagcaggaccgaatctgaattttctcaaggttaatgctgtatatgtagttccttattttctgtgatgatgcaaacagccaaggatcttttcagttagaagggactttagtaaggctataataggtctttcttttcagacattttaaaccaaggattctaacatgtgcttctcttctccaaacttgccactaaatacttaaacaacaaagacattgaatcctggctgggcgtggtggctcatgcctgtaatcccagcactttgggaagccaagacgggcagatcacttgaggtgaggagttcaagaccagcctagccaacatggggaaaccctgtctctactaaaaatacaaaaaattagctgggggtggtggtgcacacctgtagtcccagttacttgggagggtgaggtgggagaattgcttgaacctaggaggcggagatggcagtgagctgagatcgtgccattgcactccagcctggttgacagagcaagacacttcatctcaaaaaaaaaaaaaaaagaaaaaagacgttgaatcctgcaacgtgacattatttatttttattatttgaaatagaagtgcaaaatcaatgttaatcaaatatgtaaaatgtattataaatataaataagtgaatttcagttctggtaaggatgctttaataccagggttctctggcaacataattactgaaatataaaaagatgtttagcatgttgtccatagactatcttatgatttaatactcctatgaatatctacatcaactggttctgtgttaaactttaaaacatgaaccttcagaatttcattttttctttgtttcaagtttttcctttacataattttatgattacacattaaagtggaatagatagggtgaactctctactgaaacttatcaactaaaaacctgtaagccaaaaaaaaaaaaatcagggaaaaaaatctctaaatacgttgaatttatttgggaattagaaaagaggattataacctgagatgcacagctgtggcaagctacatatacatcaaagaagggaggataaagggaaatgtttttctttttttctttttttttttgagacagagtctcactctgtcgccaggctagagtgcagtggcacaatctcagctcactgcaacctccgactccctggttcaagcattctcctgcgtcagcctccgaagtagctgggattacaggcgcacaccaccatgcccagctaatttttatatttttagtagagacggggtttcaccatgttggccaggatggtcttgatctcctgaccttgtctgcccgccttgggctcccgaagtgctgggattacaggtgtgagccactgtgcctggccaaagggaaacttttatttggcaaaaggagaagttcacataaactgcttggaaacagacattggttttggatactcaaagtcagagttggcaccattttagaggaagagatgctgttactgggcaggtattgttttgagagcattttatctgaattgctgcagtcctacagaatttcttattttagaaagtccttgagacaggacttccaaaaatgtcttttatctcgtccatgcaatcatgaaccctactcctttgtgctctcctggctctagtttgtgtttgacaaacagtgatttcatcctggtatctgcaactttcataaacctttatttatatattagtacttcaaagattaaaaaaaattgtaaatctcttgcctcaagaaaaagatttagtgccaaagaataagtcttatttttaaaatattgtgaatgagacttgtttcatttgatttttttaatggcttatgatgatataaaatgaaagctatggactttaaaacatatttatcctgtattctttcttagcactggtgtcttttattaatgctaacagtcgttttaaggttgcatctcttatcacactgtataatatttgaggtaatgataatttacatcttcttttctaatatttctgtcacctattttatcttgtgtttgctagaattgtgaaaagagtgttgaaaaattgagtgctgggctcttctgctttgttcctatttcaatttcgttggtatttcaccagttgacattatattgactttcgctttatgacttttagaaatgactgctaaaattatcaaatgccttttatggggatctaatgataaaaatcatatagtttctatctttgaatttatgagtgtagtgaatatatatatttttctacactgaaacattcccacatttctagaataaactctatttggttgtgaaatattaccattttaattacttgctggatttgattagtttatattttgtttatatggtttcagaattttttttaaataattgccacaagatctcactctgttgcctaggctggagggcagtggtatgatcttggcttactgcagcctcgacctcccaggctcaagccatcctcccacctcagcctaccaagtagctgagaccacaggagtacgccactacccctagctaatttttgtattttttgtagagatggggttttgctctattgcccaggctggtcttgaactcctgagcacaagcaatctgccagcctcggcctctcacagtgctaggattataggtgtgaggcactgtgtgctgcctttacaaactttgttttgtagatacagtgtctccctatgttgcccaggctggtcttcaactcctggcctcaagcgattctccctccttggtctcccacatgatgagattacaggcatgagccccccccaccatacctggccataatttcagtttttaagtaagattggtccatagttttatttatttgtgctatctttatccagttttgatattagtgttagtctaactttgtaaatgaatttagatttccacctttttttctatgctctgcaatagtttaaatgatgaaaaattatcatgctatttggtttttgaaagttagagtgtgctgcaaaaccacctgggcttgctgatacttttagaggtagatctttgattattcttttcttctatgattattgatttgtttgattgtctttctcttcttgaatcaattttagaatttatggtttttagaaaatcatgcatctcatctacattgccaatttattggcaagaagttgcacaaaatattttcttataattattttagtatcttccatgaccatggacgtttttcttttctcattaccactattaactctttaagcaaaacattgaaatcaactttttcttccccaacctgattatcacaaattctagtagcatatcttaacttcttaaagaaaataagaagtcaactatctaagactcataggtttgataaaatttgaaagatcctgcaatccttataatttcctactgtttgtccttatcctgttcatattttattagtaatagcaaccacttaatacgtttattgtgtgtcagacacttggtaaataaaccctttacttgcattatttaattcccagagtagctctatagcctagaaattagtgttcccattttatgaatgagtaaactaaagctcagagaggttatataatttggccaatgatattcaatcagcaagtggcagaatgatgtgggaaccgagtatgtcagattctggggtttgtgcatttaatcaccactctctactttcggtatctttttcattattccaaattataatacttacttttttctaaaaattagtatataaccaagtatcaaaggcctaaataaacccatataacagcttgaaatgcgctgtaaattatgaacctaaaaaaaccttgttattgtaatgattttttaaaggatatttgttttttagatatttctgtgaactttccttaccttatctctgtattttgagactagacatagagcctgatttctaatatttagtctaacagaaaagatgtcactttttttgtatttagagagaccagtaggtgtcaactagtaattcaatttttaaaaaagattatgataaaatagacataataaagtcactatcttaaccattttgaagtgtacaattaagtagtactaagcacattgttgtacaactattaccaacatccatctccagacctcttttcatcttacaaaattaactctgtacccattaaacaataactccctgttccctgctccccagcccctggcaaccaccattttctacttaccacatgtaagtggaatcatgtggtgtttgcctatttttgactggtttatttaacttggcataatgtcctcagggttcatccatgctgtggcaggtgaatggatttccttcctttttaaagccgaataatattccattgtatgtatataccacattgtgggtatccattcatctgtcaatggacatttggtttggttctaccttttggctattgtgaataatactgctataaacatgggtgtagaactatctctttgaggtcctgtttttttatttatttatttatttatttatttatttatttatttatttattttgagacggggtctcactctgttgccagactggagtgcagtggtgcaatctcggctcactgcaacctctgcttcctgggttcaagtgattctcctgcctcagcctcccaagtagctgggactacaggtgcatgccaccatgcctggctaactttttgtatttttagtagagaaggggtttcaccatgttagccaggatggtcttgatctcctgacctcgtgatccgcctacctcggcctcccaaagtgctgggattacaggcgtgagccaccgcgcccggcccgaggtcctgttttataaaaaaaattactttacttttttaaatagattcagggtcttgttatgttgcccaggctggtctttaactcctgggctaaaacgatactcccacctcagcctcccaaagtgctaggattacaggcatgaaccaccgtgcttggccaagatcttgattttatacccagaagtggaattgcctgatgatatattaattctctttaattttttgaggaacgatttgcacttaattttaactaaacaatgcaataaaacaatgttctattgccttgggtcccagatttagtacatccctgaaagtcagggacacctaagataagataatcttgggatttatgtttggcatgaggtcctgggcgacaggggagtgggggagggccaaagttctgggatctagaacctactaaagttttccaccctagcccaccctgcctacctggcttccatagtttagaggatgcccattggtactgtggtttgagcagaatgacagaaaagctacaggacaggtcctaaataaatatggattctttcagactttgtagtgaatctgcattgttattatttagagaagcattaaggcataatgattaagaacatggattctggagcttgacttcttgggtttaacgctcagctcagcctttttttactacttgggcagttacttaaattatctgtgccacaatttccttatatgtaaagtagttattataataatatctacctcataggattattgggaggattaaatgaattaatacatgtaagtgcttagaaaaatacttgacatatagctctcactcaatgttagtaataatgataatattattttttagaaacagggtcttgctatgttgcccaggctggagtgtagtggtgtgatcatggctcgctgcagcctctacttcctgggctgaagcagtcctcctgcctcagcctaccaaagtactgagattacaggcagtagccaccacgcctggccgaataatattattttaaattagcataggttatgatgtggctttccttttaaaatttattttattttatttttttaatttttaaatttatttatgtggctttccttaaaaaccaatacgaagagtaagattccattctgtgagttaaactttttggattgcttatactatgaataaaaaagatgtaacggcagtttaaagaaataggatttgctgtccgatcagcaggattagattatagcttgatgaattctaatctatttagtattatataaattggattgtagcttgatgaaacatagaaaacggatttctagtcacatagaaaatcgatgctatgacaggagctggtcatagaggtttgtgttgtctcttgttgcctagaccctcccaaacattgtccaggaatgagatgcctttgtgcataccccatccaccacttcattctaagcagatgtcagtcaccactactaaagcagaatctgatagcactaaacatttgagtcacataatggactcctctaatccataaggcaaccttatgataatttggcttgctatgtagcttatctacatggagaggctatgtaacctggatgacttgaatatatgcttgcatatccagttataagtcttactagaaatcagtacattagttttttgtctttacatgtcaatctcaagaggtttgttaatccaaacctgcttctgatgagtaaatccattctccctgtacttactaagtaggtagttgagcatataaagctaagacccccaaaccctggaccttggtagattcaccaagataatgtgtccgtctcttcagtctcattgttttcttgggatatatcccagtgccttttccagatcatcatattactagctaccttaatttacttctattttctttatttccattagttctatatgtgtggtggcagagatattcttccatatcaccattgccagttggctgaagaggggtggagcaacccaatttctctctctcaatccccggccagcctgatatgaccaagaatcactgcgtagtgagcaaggaaagctaatcactgcactgcaggatctcactttgtggaactattgctttgctatatgccttcttatagcagacggagctgaaaggaaccttaaagatgaactagcccacatttcttgttttacagatgaggaaacagattacttgccttggacagtatatctttatgctcttctaacagtcttttgtctaaggttggcctggacttacgacctgtgagtaatcttctttgtagccctagtcttatcgaaccagtacaaaagtttaactgccaaaggcactttctttcctatagttctgacaacttctccttttgttatataccactgatatccaggttcagttcatcatctatttcagaccatgtttctaattggattctctgtagcctggttcatgttgtagtctgccattttctggcaacaaattggatctattttaataatgatcagagatgctggatttgtcatgttgggatctttttaactcagtatcccaaattgtggacataggatttcatgaaataaaaataaacctcaacagtacttctttaaataatactcactatatacccagaataaaactatattccagtaattccattaaaatttgtatgctaacaataaaactttgttttaaaatttttattcatgtttattttaaccacaatactaattgctattcctaaaatatgtttttctttctcctcctcccttatggagtattaaatgttttaatgtcatggcaaactcttttattagcttaggattactttatatatatatataaagaaaaaaattaatagcaagttacgagaaaatgtacatttttcttgtaatgtatctttacatatttcaaagaggcaagtggcagcaaatgtgaaataagcataagcaaagtgctttcatttaagtgcttagaggattaatcaaggagcacttcctagaagtgtgttttgaagattttaagagaaggtacaaatattcactggtgacgaggatggagtcagaaagagggaagtaaaacacacattatgcattgggagctgcattagaaaggggaatggatgctaacaaaaagaaaaaacatctcttgcaggatggtgaagcaggctttcagctgggatggagaagggatgctgagttacaatcattggtgaagttattgagatgtcatttcagccttgctactcacattttgctgggtaatgtgctagatcctaagggaaaagctaaagagaagggagagacagtgcttgacctgtaggtacttatgatcttgctgatgagacaaggcaacaggaagttaaaggaggatccttgaaagccagtaagaggaacttggattttatacagtatgtgatgacaggagccattggaggttctcatgtatcatcttacctctatcatctgctcagaagggagaggtctgagctggggaagatcaaactgagcaggtggctaggttttaatctttatagctatatgtaatcagcagaagagctttttcccacacaaaactattttgaatcactttagaaaaaaatgagctgcctaaaatcttctgtccatgattaacaattaatagaaaatcactggtttgctcctgcaaacagcacttaatgtcagtagcttcaggctgtttttcaattttacagtaaattttttaccgaaacaaatttaggtagctattttgtccatgggcttttgtagtggaaagatgatgtgagtaaaatagaataatgagattccttttctgcatcaaaatattagcaagctgctaatggttccattttgatactgccactttcaaaataaaggagagagatcaagttgcttatggaaacattttggattatgtttaaaatagtgtaactttataatagttgatatggtaaataattcaaggtttgcttttagtgcatcagtttatctccatcttggctcagccctgagagagaaagtttccagatttttattgcctatctaataagtcccttggtaattggtttcatgctgtaggaatgtagattttatttcttccctttcttcttcttcttttcatctgcctccttgctacttgcaaactgttctgtgatttccactatctccactgaccttccagtgggaagccttccaaggtccttggtttcctggaatgacatttgaggcatatttaagtgccttacgatattcctgggtttatttgggttttggcccatatgcattggtggtaagtccctgagaggcactagcacaaaaacaacaggagccctgaggtctggaggtaggttgggttggagttgtccactcggcatttgaaaaaactgtccaggaaaggcattgtttaaggggtagctctctaaagcctcctgagcttttgtgtttggattcctttttgtctggagaagaacatcagtgaagtaaggttttacgcctgttatggcattgatttcatatgcgttgtgcctgtcagccagtgctctcccagttaaaatgggctgaaaaacatgtgatcctgagacaccacttataaagctgtggagaacagaatgccagatcccaccacttattggactcaaaacaacccgcggccataagctggccaggctccggagagcttcgcggttccatgctgaggcaggaaagtccatctcagtatgatagagctgagaaaaataaatactaagagtgatgcctggatacgtaatcaggaaattatacattttgctgatgcagcagtggttagcttcattacaaggggagttgttggaatacagaatgatatgcctgatgctgtcattattgtatatggctgagtcaagataaccattcatttcaaagagcattgattctggatggatataattcccagtgcaactgctagcatggcccttttgcaccaggctaccagaagaagtttttagttcataaaatgtgaggtgttttgtttgaggaaatgttgtcccataagggaatccaaaaatctgacaaaattctgtgagggaaactcttgcttcttcacctgttcgaatatggtaaggacaattagagcaatcgagagagaagcttagccagtaatatggttttactattgttccatgatttgctaggtactcctcatatatgggctccattgctagatttactgtcttctagctgcaaacctaaacaaggaagagaaattacatataaaaccagcgcaggaaaaactgaagacagtgcattaatttattaaaccatactttctttaaaggaagtagcacaataaagatagtgatatatgcatagatttaaaagctcaggattcattattctttattgagactcctagagcatggggaggaaacagaagagaaaggcgttcttcaactttacctgtttcatagattccaagtcagtaaagcaaatgagttaacaatgcaagttctagaaacagactgtctggttttaaatttgggcttggccaattatcagcttggtggcctttgacaagttatttaacatttgggagccacagattccttgtctgtaaaatgaagatattaatagtacttacctgataagattgtcttgagcattgaataacagaatgaatataaaatgcttcactaatgtgcttgtcacatagtaaggactcagtaaatattaactcttagtagtaaaagtacaaatcctagggttatctagattattcctaattataaaagtacaaaaaagtgttttgcattttgttcatgatctttcttctcagaatatgttaacatctaatgtattgtgcagaactattcagtgtgcttgcatttaacatcaactttcttaaaatcactggaaataatttggaggtttttgggttttttttgagactaggatcatgggatctcttttgcttaatgatagagacttcttaggaaagtgccacttgagtattctttggattgtggacactcattcattgacatgtaagagttttctttcccgtgagtgggtcttgttagaagacttttgaaaaattactgttacagaaagcaaatatggttctttagaatatttcaaattagtagtttctgggatgttaaactcaaaaagctgagatctttaagtaatgattttttcctttaaaaaatattccttcagttatcgttgttcctataatgctctaggagctacctattttgtttgtttttgagacagtcttgctctgttgctcagattgcagtgcagtgagatgatcatggctcactgtggccccaaccttccgggctcaagtgatcctcctgcctcagcctcccaaatagctgagaccacaggtatgtaccaccatgcccagataatttttttattttttaggagggatacagtctccctatgttgcccacactgatctcgaactcctgggctcaagtgatcctcctaccttggcctcccaaagtgctgggattacaggtgtgaaccaccatgtccagccttccgtcactattaacatgtctattccctccagtctttttgctatatgtgtatgttacatataatataaacaaagtcatgttttataccctgctttttcacttaatattgtgccatgagcattttcccatgttattaaaaataatattcggccaggcgtggtggctcacgcctataatcccagcactttgggaggccagggtgggcggatcatgaggtcaggagatggagacaatcctggctaacatggtgaaaccccgtctctactaaaaatgtaaaaaattagccaggtgtggtggcatgcgcctgtagtcccagttactcgggaggctgaggcaggagaatagcgtgaacccaggaggcagagcttgcagtgagccaacatcccaccactgcactccagcctgggtgacagagcgagactctgtctcaaaacgaaaaacaaaaaacacaatattcatggctaattagttttttattatgtaactgtaacattcagtttcttgcctcttttaattattataacactttgataaatatttctgtgagaaattatctattgcatatattatataatatttattataaagaatcagatttttttttttttttagaatagattactagaaatcatagtattaggtcaaacattgtcaaatcgcttcctaggaaggtgtaccaatcttatcacattctcttacaatgttgtttatcccaatttgagaagggagcattggtatttttttgttgctataatgtgtgcctttattatttctagtgaagttgaacactttttgacatgcttattggtctgtggtatttattcttctgtgaaatatatttgattttttacctattttttgcgtgaagttttccttattggtttgcaagacatttttatgcatcaagaatattaaatctgccacatttgctgctaatattttacctggtttatacagccttttaattatgccaatgttattttaattgcaccaaattttacatttttatgtggtccagtctctactcctgtgattttttttcttattgtatttagaaatgccttcctcatcaaagcataattaagtattccccatattttcttctagtatttatggtttcattttttacatttaactttgtcagataacaaaactgataaggcagaaaatttaaatgaggtaaactgaccattgcaacagaatatatttttcacttttcaaaatctcacttatcatatcacaagtatgaatacttgtgctaataaataaattatggcctctcatatggaagtgctatgttcaccttctgtcttcctcagcccacatcagctcattcattgctgtatttgatacagcttgatctctagcctgaaacctgcagagttcctatgctaatcctatcctgggcagaaaatatgttaaaagcctcaatccagctgtaggtggaatgtagctttattcatgtcaccattatcttagtggctaatatcctgcagtaactctggcaccacatacccaccagattctagatttctcctagcctctgctgtgtcatcttaatccataggattggacattagctttgttttttccttagtactatattttcctgatgtaactgaattcctgccttgaggcttcctagaccttgtcatagctttccttctagagagctggatttaacccttggcagtggacgatctcttggaacctgacgccatttcctgcttactcccgagcattgtttcctctctggacctcctccttgcttagccttcatcaggctggatggatctctccatcagaacttgccaaaaccaagcccaaactttcatgctttttaatattgtgcccttgatgtggtcgacttatgggtggtacaccggacatccaggttactgctcagattacaatttcaactcacccatagacaatttacagattgatttggctaaatgttatggaaacagaaccaaaaggcacttttctgtctttattactatttcttaaggtgatgtgtatgtggagttaactatatataatggtcccataattacccttttgggaaacaaaagtctttgtgtgtttttagataaaggtagcaaaatggaaactccctattgcttttctaagcacgccttcctttgcacccccatcttctgtggctgttttagccagaaatgatacatcattactgtctttaaggagatggagaggactgtggctttaacacatagtggagggagctctgtagtctcattcttgctgacaacttttcagtgtcaaccaactatagtttcctattggtgaagttttcactttttcagagtctttctgggcttgttctttgatcaccctcatctgaagaggaagcaggaaagaactgttgccctctttgaactcttagagaattcatggtttattgtatcaatttgttatcgaccacagattatcttgttaacttttggtatctgtcattttattctccccaaccaggtggaaatgtaccctgtttaggcccaggacctaccttagcaaccttgattggctcacaagccaggttgcttaagacttgtttccccagcagctggtgtccctacttcctgcctagcccttttccttttgctttgtctgtgcttgggaaatacatgttatactctgtagagcagatttgctggcagtaagaacagagatgtgtagagcccagcgtgctggagggctctctgcatctggctgtgagtggcccctggactgggaccgtgggaggacagctttccatagtttaacataaatgaaccacaccataaggacaatctgctctcatttcactcaactaggatttagtgagtactgttaaagcacagtttgcactggagtaattggagaatggagtttgcccttcacaatctgtgcacaatctgttagcagctaaaaacaaatgttagcagttataattaccatcaatttgtctccaggcttggatcacattccaggtgttagaagagatggtccatttccttttttttctcctttaagtcccatgccctgtttcaagtagcttcagaaggcaattgtgctgtaaagattcaccttgtaatgggttcaggactctttcacagtttgtgtctattcgttcatttgaactttgctgttccaagttagaaagcccttgctgaggtgtggctacctctaagaacactgttgattgggtgccatggtaacgtttgcaaagtagctactgctaggatacagctctgacacttattactttatttgcatatcaagccacctgttccaaagatgaaaatatacaggactgcatatcccagtctgggtaaaaggataatagctgactgttgaagagaacatgttgcagtttttctcctgctagctgaagaatcaagttctgagggcctgctcctcagcacctttctcctggtctagagtaggtgccaggcctggcggttctgttgcctgcgtgggtgccagggcttctccttgggaggcttgccctctgtgagagggagcagagagttgacttcctccaagaggcccatagtccctgaagggggtgtttttgattctgtctaaacctaggctatgtgttagcggtttccctcctcttagaaattgcctggaagactcttgctattggtatgtatgtggttccctccagtttaagacaagatttgttccaggatcggttgtagccccttctctgtggctaacggaagagccacttgtccttctccattcttttccttagtctcccttgacccccacatcatctcctagacacaaggcacattgatagtcacaattcactgtcaatcactctggattattccctcattcccctttcccaggccacctgaaggagtgagtggggattgctattgtgtacattccagtaataactattggctgtaagcagacatactctaaaaataactcagggatactgagcacccagagggcaccttctgtcttctcgaagcttcgccacgcctgtttccactgtcagacttccagtctgcaccacagcacacatcctttctcatccagagtgctcctactagacgagatgtttttgtctcctaagggcctcaggtgtattcatgaactcctcagctggttattttcagtttcatcttccttggtgcttgctctggcacatggtcactgctgcatcctgtcccttccccacagtttgccatgggtcatcccttttttctcattgcttgcatcttctaactgaatgaacttgtaaatatggaactgaaagtcaatcctcatagctcatcttttatttaatcctaataaatgacaatctattgcaaacattactttaaaaatattacttatcaaaagctgggtgaaaggataatagctgactgttgaagagaacatgttggggtttttctcccgctagctgaagaatcaagttctgagggcctgctcagttctgtaagaaagtattagctgtctgacaggttccagtgaggggaggaaaagacaaaaaatatagtccccaaatctgcaccagcatcccatgtgcactgtgcaccttccatggtggattagatgctcagcaaatgatatacctatggaaggttaagcctaaagaaacaggaaaaatgagcctttgtccactagcacatttatcaattgcattttagggtgattttagggataggcaaccccaattagtcattattctttaaaggtagttgtctgttagatgtaggaagactccaaggaatgttaagttggcaacattccatttaggttgcacagaatgacttttaagactaaacttcatcaggaggaaatgaaaggcctttaccatggttcctgttcacagtgaaattgacatgtattggaaaggagatgcttggaagaaatgtctagcttccccaacagactcctttcttctcttttctgtcttcctttgttaatctgccatgtttcatcttcattcagatgagttatgatgtatattatttatgtagagatattatgagattataatgaagaagatttacaaagactaaactatcctgcaatgatctaaatttttaagagacatttactcagtttggcactccaaaaattattaatctatgttctgacaacccagtttggggtatatccaagatggcttgtgtgttgctagttactgcttataaggcaactttctctttgggtggcaggaagtaaaatatttataagttattgctaaaatgttaaagttttatttgaacctactgtacccaagtaattatataattcatcactttagtagcagtttggttgacactgaacaacaatgctcaaattcatgtagcagtaacaaactacgtgataaaaggaactgaatttagaaagcaagcttcaagtaaagatcagaagattaagtagatttcatggagctcactaaggagttagatgggaaagatgagataagaaaagcactggagttgagaccaaaaggagacgaaaaagcagagggtggatcttcgagctcggggggttataaacaagatggccacaaggtggcagcacagtcttaacagcagagagctttctgtagggccacccttaatttgctaacaccacagactttctcttagaattcctccatgttgattttcctcattatcctaggggaaacagcagcaaatgtttagaattaaaaatgactcctaaaacttaagctgaggaaaagtatagggtaaaggcagcatctttacttccagagactgtttagatgctctaaagaaggcttccaactctctgtgggaaaggaccaattgacatttccaaaccatatgttaaacagtgatgggaggccattgttttgggctaagcttgtacactaggccccagccgaccagaccaaaccaaaatggagtcactcatgctaaatgtgacataaactaaaattttaaggaaacagatagatcccaaagcagaccaagttttttttcttttcttttcttttttttttctcatgaaaacaggagattccggcacaaggaagtccccttggctctctaactcttacaaaaaagtaacctgaaatccatgttcccaccttaaaaaccaactgttctgctctttccccgtgggatctgagaccaaataagtacatttatgatggtaacagagtgacctcaatgcctaaagttttggtcagtgtcaaaattgagaggttgaccaaaaggtggggaattgttaaattaagtttagcctaaagctgcctccttacatattttaagttcagcctaaaggtttcttcgtactcagcgaattgtaacctaactggaatgtaaatagactgtaacctactcttgtaccaatcaccaagttttggccaaaggcagccaactgttcaaactgtgttcaaatcagggaaatgccaagctgtaacaaatccagctgtttctgtacctcacttccattttccttatgttgctttccttttttgtccacaaatcctctgtgaccatgcagcagcactggagatgctttgaacctattctggtttggggagctgcccaatttgccagtcgttccttgctcagttaaactctgttaaatttaatttgtctaatgttttaacacatcatacactaatacttttgtaaaagttaataaaaatgatattatacaaagaagaacaaaaaagacatacagaacataaacctattttttggtaattagttaaactaattgtgaaaatagcacatcaaactttctttttaaggtttttgaaaaccagaaaatctaattattatgctctagccaaactacccaatgtttgctttacattctttccccacaaaatgaaattagtgaacttaggcagactcaactaagttcacaaaatcgactcaaaaaaaaaaaaaaaaagattgctttgcttattggggtcttttgtagttccatatgaattttagaattttttttatttctgtgaaaaatgtccttggaattttgataagggattctgttaaatctgtatagcactttaggtcatatggacattttaacaatattaattcttccagtccatgaatatgagacatcttgagacatctttccatttctttgtcttgttcagtttttctaatcaatgttttacagttttcagtgtataaatctttcttttttaaaaaattttattattatactttaagttttagggtacatgtgcacaacgtgcaggtttgttacatatgtatacatgtgccatgttggtgtgctgcacccattaacttgtcatttagcattaggtatatctcctaatgctatccctccccgctccctccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatcgttgaactagttcacagtcccaccaacagtgtaaaagtgtttcaatttctccacatcctctccagcacctgttgtttcctgactttttaatgattgccattctaactggtgtgagattagatctttcaactcattgcttacatttattcctaagtattttattctttttataaacgggaatttttcgggggtggagccgagatggccgaataggaacagctccagtctacagctcccagcgtgagcgacgcagaagatggctgatttctgcatttccatctgaggtactgggttcatctcactagggagtgccagacagtgggcgcaggacagtgggtgcagtgcaccatgcgccagccgaagcagggcgaggcattgcctcactcgggaagcgcaaggggtcagggagttccctttcctagtcaaagaaagggctgacagagggcacctggaaaatcaggtcactcccaccccaatacagcacttttccaacaggcttaaaaaacggcgcaccaggagattatgtcccgcacctggctcggagggtcctacgcccacggagtctcgctgattgctagcacagcagtctgagatcaaaccgcaaggtggcagcgaggctgggggaggggtgcccgccattgcccaggcttgcttaggtaaacaaagcagcctggaagctggaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacacagctggagatctgagaacgggcagactgcctcctcaagtgggtccctgacccctgacccccgagtagcctaactgggaggcaccccccagtaggggcagactgacacctcacagggccgggtactcctctgagacaaaacttccagaggaacaatcagcagcattcacggttcacgaaaatctgctgttctgcagccaccgctgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaatacagctcctcaccggcaatggaacaaagctggacggagaatgactttgacgaattgagagaagaaggcttcagacgatcaaactactccgagctacaggaggaaattcaaaccaaaggcaaagaagttgaaaactttgaaaaaaatttagactaatgtataactagaataaccaatacagagaagtgcttaaaggagctgatggagctgaaagccaaggctcgagaactatgggaagaatgcagaagcctcaggagccgatgtgatcaactgaaagaaagggtatcagtgatggaagatgagatgaatgaaatgaagcgagaagggaagtttagagaaaaaagaataaaaagaaacgaacaaagcctccaagaaatatgggactatgtgaaaagaccaaatctacgtctgattggtgtacctgaaagtgacggggagaatggaaccaagttggaaaacactctgcagggtattatccaggagaacttccccaatctagcaaggcaggccaacattcagattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagtggatctctcggcagaaactctagaagccggaagagagtgggggccaatattcaacattcttaaagaaaagaattttcaacccagaacttcatatccagccaaactaagcttcataagtgaaggagaaataaaatactttacagacaagcaaatgctgagagattttgtcaccaccaggcctgccctaaaagagctcctgaaggaagcactaaacatggaaaggaacacccggtactagccactgcaaaatcatgccaaattgtaaagaccatcgaggctaggaagaaactgcatcaactaacaagcaaaataaccagctaacatcataatgacaggatcaaattcacccataacaatattaattttaaatgtaaatggactaaatgctccaattaaaagacacagactggcaaattggataaagagtcaagacccatcagtgtgctgtattcaggaaacccatctcacgtgcagagacacacagaggctcaaaataaagggatggagaaagatctaccaagcaaatgcaaaacacaaaaaggcagaggttgcaatcctagtctctgataaaacagactttaaaccaacaaagatcaaaagagacaaagaaggccattacataatggtaaagggatcaatgcaacaagaagagctaactatcctaaatatatatacacccaatacaggaccacccagattcataaagcaagtcctgagagacctacaaagagacttagactcccacacaataataatgggagactttaacaccccactgtcagcattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaattgaccacatagttggaagtaagctctcctcagcaaatgtaaaagatcagaaattataacaaactgtctctcagaccacagtgcaatcaaactagaactcaggaataagaaactcactcaaaaccgctcaactacatggaaaccgaacaacctgctcttgaatgactactgggtacgtaacgaaatgaaggcagagataaagatgttctttgaaaccaacgagaacaaagacagaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaagacattcaaaagctagcagaaggcaagaaataactaaaatcagagcagagctgaaggaaatagagacacaaaaaacccttcaaaaaattaatgaatccaggagctggttttttgaaaggatcaacaaaattgatagaccgctagcaagactagtaaagaagaaaagagagaagaatcaaatagacgcaataaaaaatgataaaggggatatcaccaccaatcccacagaaatgcaaactaccatcagagaatactacaaacacctctatgcaaataaactagaaaatctagaagaagtggataaattcctcaacacatacaccttcccaagactaaaccaggaagaagttgactctctgaatagaccaataacaggctctgaaattgtggcaataatcaatagcttaccaacgaaaaagagtccaggaccagatggattcacagccgaattctaccagaggtacaaggaggaactggtaccattccttctgaaagtattccaatcaatagaaaagagggaatcctccctaactcattttatgaggccagcatcatcctgatatcaaagccgggcagaagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacctttcatgctaaaaactctcaataaattaggtattgatgggacatatttcaagataataagagctatctatgacaaacccacagccaatatcatacttaatgggcaaaaactcgaagcattccctttgaaaactggcacaagacagggatgccctctctcaccactcctattcaagatagtgttggaagttctggccagggcaattaggcaggagaaggaaataaagggtattcaattaggaaaagatgaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcttgagtgaactcccattcacaattgcttcaaagagaataaaatacctaggaatccaacttacaagggatgtgaaggacctcttcaaggagaactacaaaccactgctcactgaaataaaagaggatacaaacaaatggaagaacattccatgctcatgggtaggaagaatcaatatcataaaaatggccatactgcccaaggtaatttatagattcaatgccatccccatcaagctaccaatgaccttcttcacagaattggaaaaaactactttaaagttcatatggaaccaaaaaagagcccgcattgccaagtcaatcctaagccaaaagaacaaagctggaggcatcacgctacctgagttcaaactatactacaaggctacagtaaccaaaacagcatggtactggtaccaaaacagagacatagatcaatggaacagaacagagccctcacaaataacgccgcatatctacaactatctgatctttgacaaatctgagaaaaataagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagtttttgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtggacgaaggatatgagcatacacttcttaaaagaagacatttatgcagccaaaaaacacatgaaaaaatgctcaccatcactggccatcagagaaatgcaaatcaaaatcacaatgagataccatctcacaccagttagaatggcaatcattaaaaagtcaggaaacaacaggtgctggagaggatgtggagaaattggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagacacgtgcacacgtatgtttattgcagcactattcacaatagcaaagacttggagccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaaccattgcaagaacaaaaaaccaagcaccgcatgttctcactcataggtgggaattgaacaatgagaacacatggacacaggaaggggaacatcacactctgaggactgttgtggggtggggggaggggggagggatagctttaggagatatacctaatgctaaatgacaagttaatcggtgcagcacaccagcatgacacatgtatacatatgtaactaacctgcccattgtgcacatgtaccctaaaacttaaagtataataataataaaataaaataaaaataaatgggaatttttcttgatttccttttcagatagattatgattggtgtaaagagatgcaactgtgttttgtgtgttgatttttgtatcctgcaacttaattcattttgtgttctttacggttttcttcatataggatcatgtcatttactgagtacgtgctctgtggcaacaattttacatgcatcatatctgtactagtttagaattattataatttttatttgacaaataaaggaacttgggctcagagttgtttgctcaagattatacagctagtaactggcagagctgagatttaaacccagagcactctaactctaactccagagggcatacttttttttttttttaatgccataatcctgctatcgcatcctactttttgagcaaaataaaataatttcaaatttatgaactagtcttaagataaatgggaaaattgtatttcaaaagtgagacagtgataaagctaaggacaagaaaaaaatgttaactttgtatcctgtaaccttgctgtaattgcttattatagttccaggagtttttcggtcaattctttttggattgtctacatagatgatcatgtcatctgcaaacaaagacagttttatttcctcctttccaacctgtatacttttttttcccaatcttattgtgttagctaggatttccagtacaatgttgaaaagcagtggtaggaggggacatccttgccttgttcctgatcttagtgggaaagctttattgttttttaccattaagtatgatgttagttgtagattttttaaaaatcaaggtgagaaatttcctgtctattcctagtttgcagagagtttttgtatttaaaatcattaatgggtgttagattttgtcaaatgccttttccacattcattgatatgtggaaaaatcatatgatttttcttctttagcctgttaatgtgatggattacattaactgattttcaaatgttgaatcagctttacatagctgggacaaatcccacttggttgtgatgtgtaattctttttatatattcttgaattcaatttgctaatactttcgttgagaattttcacatctatgttcatgagagatattggtctgtagttttcttgtaatgtctttgtctggttttggtattagagtaatgctggtctcataaaatgagttagtaagtctttcacttgcttctatcttctgaaagacattatagataattgtgtaatattttccttaaatttttggtagaattcagtgaacctatctgtgcctggtgctatatgttttggaatgttgttaattgttgattgaatttctttgatagatataggcccattaagactgcctatttatcttatgtaagctttggaagattgtgtctttcaaggagttcgtccattttatctaggttgtcaaataggtgagcatagattgttcatcatgctccttgattatccttttaatgtctgtgagatccgtagtgatgatgtcccctctttcatttctgatattagtaattcgtgtccttctgttttttcttagttaacctggcttgaggcttattgattttattgatctaaagaaaacctatcagctttcggtttaatgattttctccattgtttttctatttttaattttattgatttctgcactggtttttattatttcatttttttctgcttactttgaatttaatttgctgtgctttttctagtttcctagagtgaaagcctagatgattgactgaaggtcttctttttttctttttttttttttttttgagatggagtttcgctctttttgcccaggctggagtgcaatggcgtgatctcggctcactgcaacctctgcctcctgggttcaagtgattctcctgcctcagcctccagagtagctgggattacaggcatgcaccaccacactcggctaattttgtatttttagtagagacagggtttctccatgttggtcaggctggtctcgaactcccgacctccggtgatccacccgcctcggcctccgaaagtgctgggattacaggcgtgagccaccgcgcctgggcctaggtctttctttttttctaatgtatgcattttatatatatttccatctaattattgcttttgctgcatcccccaaattttgaaacattgtattttcattgagttcaaaatagttttaaatttctcttgcaagttattctttgacctatgtattatttagaacttcgttgtttaatttccaagtattttggaattttccagctatctttcttttttcttttttaaaaaattgagatgaggtttcaccatgtttcccaggctggtctcggactcctgaacgcaggccatccacctgatttcagccttacaaagtgctgggattacaggtgtgagccaccacgcctggcaggaattttccagctatctttctgtttctgatttctagttgtaactccactgtggtctgaaagcagacactgtatgatttctattcatttacatctgtgaaggtatgttttagggtccagaatatggccaatttggtaagtgtttcctgttagcttgagaagaatgtatggtgttgaatgaagtaatttataaatgtcaattatatccagttgattgatggtgctattgagttcagctatttccttactgattttctgcaggctgtatctgcccattctgattgaggagtgttaatgttttcaattttaatactggattaatcttttgccttgaagttctatctgtttttgcttcacatattttgatactctgttgttaggcacacacacattaagcattggtatgttttcttggagtattgatcccttaaccatttggtaatgcttctctttattcttgacaactgtctttgctctgaaattaatgtagctactcttctttctttcgattattattagcatggtatatctttctttatctctttcaatctgtatgtgcctttatatttaaagtgggtttcttttaaacaacatatagccaggttttgtttttttagatcattctggcaatctgtcttttcattgatgtatttagatcattgatttattttttatttatttatttttttgagacggagttttgctcttgttgcctaggctggagtgcaatggcgcgatctcggctcaccgcaacctctgcctcctaggttcaagcgattctctagcctcagcctcctgagtagctgggattacaggcatgtgccaccatgcctggctaattttttgtatttttagtagagacggggtttcttcatggtggtcaggcgtgtctctaactcccaacctcaggtgatctgccctccttggcctcccaaagtgctgggattacaggtgtgagccattgcgcccagccagatcattgatgtttaaagaaattattggtatttggattaatatctaccttatttaatactgttttttatttgttgctcttattctttgtttctatttttgccttccacactttttcaaccttttatattttttattgagcaatctgtatgattgtatttttctgtcctttcttagcacatcagttctacttctttttaaacatttttcagtgattgtcttagagtttgtaatattcatttataactaatctaagtacactttcaaataacactatacggcttcaggtagtacaagtactatataataacaaaatatttctactctctcatcttttgtatcattgctgtgatttattttacttacatgcttatatatatgtgtgtgtgtgtgtgtgtgtgtctgtgtgtaattaaatgcattgttgctaatatccttttaaacagtcatctgttagatcaattacgaataaaaaaataaaagtttttattttaccctttacgtattcattctcaaatgctcttcctttctttatataaatccaagtttctgagctatatcattttcattctctttgaagaacttttaaaaatattacttgcaggtcaggcttactgacaacaaattctctcaatttttgcctgtctgaggaagtatttctctttcacttctgaacgttaatttcacagggtgtggaattctaggttgatgagtttttttctatcaacactttaaattttttcttccactctcttcttgcttgcattgtttttgagaaatcatgtgtaatttttatctttacttctgtgttcataaggtgtttaatgatttatttttaatttaatttaatttaattttttaagagatagtgtctccctatattgcccaggcttgtctggaactcctggcctcaagcaattctaccacctcagcctcccaaagtgttcagattacaggcatgagccatgagccaccacacctggctgcgattttttctttatgtttaattttttgaaatttgaatatctatgcctaagcatagttttttttgttttctttttgttttgcatttatcttgcttggtgttctctgagcttcctagatctgtggattggtgtctaacattaatttgggggaaattttcactcattattgcttcaaatattgcttctgctcttttctctttttcctctcctgggatttccattacatatgtttacaccctttgtagttgtcccccagcttttggatattctgttatgagtttttattttcagtctgttttctttttgcttttggtattggactttcttttctttttttttttttttgagatggagtctcactctgtcgccaggctggagtgcagtggcagtggtgcaatcttggctcactgcaacctccgcctcccgggttcaagtgattctcctgcctcagtctcccaagtagctgggattacaggcatgtgccaccatgcccggctaattttttgtatttttagtagagatggggtttcaccatgttggccaggatggtctcaatctcatgacctcgtgatccacctgccttggcctcccaaagtgctgggattacatggacatttttattgttatgtccccaagcttggagattctttcttcatcatgtccagtctactaatgggttcatcaaaggcattctttgtttctcttacactatatttttttgtaatctctgtgatttcttttttgcttttagaattttcatgtttctgtttacattatatacctgttcttgcatgctatctactttttccattaaagtccttagcatagtccatagtccatagaagcattaaatttctggtctggtaattctagcgtttctaccatatgcgattctgtccagatatgcttgttcagtctcttcagatctttaaactgtgttttttgtcttttagtttgccttataatttttggttaaaaggtacacatgatgtactgggtaaaaagaactgcagtaaataggcctttagtaatgtagtggtaaggtgtaggaagaaggggaagtgtattagttcattttcatactgctatgaagaaatacctgagactgcgtaatttataaataaaaagaggtttaatgcactcacaattccacatggctggggaggcctcacaatcatggcagaaggtgaaggagaaacaaaggcacatcttacatggcagcaggcaagagagaagtggcgagaaaaagggggaaaaaccccttataaaatcatcagatctcatgagaactcactcactgtcatgagaacagcagcatgggggtaaccacccctatgattcaagtacctctcaccgggtccctcttatgacgtagggattatgggagctacaattcaaggtgagatttgggtggggacacagccaaaccatatcagggagcattctgtggtcttatgagtaggtctcagtcttttggtgagcttatgcccctgaattgtgaacttcatcactgtttctctgtccctatctctctccatctccccactcccactcccacactttacatgggaaggaatgacttagaaggggttggaattgggtatttcttttcttccatgtggaaagctagagggagctgggttggctatttccctttccccagcttgatcaggctctgatcaaaccccagtaggctctggtaaaatagtttcttctgaggccaggctttcttaagaacagaatgctctggcacatttcaaaattggttttattttgtgtccccctgctggaatcataagggaatttttctctgatatttgctgtcaggtagagctcctggatgtaaaacgcataaaagtgtggaagcccccatatgactgggtctctctggagttttaaacttacagttgtcttcactgagcctctagcaatccattaattacagttcaggttttcctatcctagcacttgttcctgtggaggtttttgcctgggagtttatgttctgataagttgtgattctcagtatctgcctgtctctctgatatttggggcagtggtttgtcctataactctacttttctgatggttctaagaagagttgttgatttttcagtctgttccagtttttacgtgatgttaggatggagtagcaacttccaagctccttacatgctgaaccagtttattcctttttaatgctgaataatattccatcgtatggatatactacaatttgtttattcatctgttggtggacatttgaattgtttctagtgttgggctatcgtattagtccattttcatacttctgtaagaactgcccaagactggtaatttataaaggaaagaggtttaattgactctcagttctgcatggctggggagacttcaggaaatttatgattatggcagaagaggaaggggaagcaaggtaccttcttcacaaggtggctggaaggagaagtgctgagtgaaggaggaagagccccttataaaaccatcagatcttgtgagaattcacccactatcatgagaacagcatgggcaaaactgcccccatgattcagttacctccacctggtctctcccttgacatgtagaaattatggggattacaattcaagatgagatttgggtggagacacaaagcctaaccatattatgaaaaaagccactctgaacattcatgtttaagtctttgtgtgaacatatgttccacttttcttgcatgtatacccaatagtggaattgctaagttttatgataaataaatttcaactttctaagaactgccaaactgttttccacagtgatttaccattgtacattcccactagcaatttatgagcattccagttgctccacatccttgccaacacttggtattgtcagtgaaaggaagcatttactatatcaatttagaaagactagtttcttctaagcttgccatttgacagaaagggaatgaagagtggatgggactctgtagtttcttcatttggatagctaatgccccataaatctccaaagataccacatttatcaagaaatttgatatttaaattatcaccattttcagcttctcttgtcccaatttcttccaaatggagctaaactcagttcaatctggttttccaattaggtagagtatatggaagctgagaggaagtattatggctgtagactcagtagggcatatggtgagctctgaaaatcctccaagtggttgctgttgagaaattcattgtcggtctagttgtttcattatagataatttttctttgtgacatttaagaaacattccttacctttgattttttttttcttttttttttttgagacagagccttgctctgtcacccaggctggagtgcagtggcgcgatcttggctcactgcaacctctgcctcccaggttcaagcgattctcctacctcagcctcctgagtagctgggattacaggcacccaccaccatgcctggctaatttttgtatttttagtagagatggggtttcgccatgttggccaggctggtttcaaactcctgaccttaggtgatctacctgcctcggcctcccaaagtgctgggattacaagcatgagccatggcgcccagcccttacctttgatattttaatttcactatgatgtgtttaggtatggatttatcctgcttaaaacccaaatttcatgattcttatttttcattaattcagaaaaatagtcattattttctgagtcttattttctcaacagagaaatgtttctctgttctcaacagataaaaatatttctctcttttcccatcttttggaacatagatttggtatatgttgaacattttcatttattctatgtgattcttcatttctcttttgcagtggctataaaaattatcattcatttttcaatgctgcattctagttaatttctccggatcagtcatctagttctccacttctttctacaggtctttaatctgctatttaacctacttaaggggttttaaaaatccagtgcttatgtttatcatttctacatgctttagggattttggtctttaattaatttaaatgttcttatagactataacaaacaattctattttctaaagttcttgggagtctaactctgctttttgttatttctacctactcttgcttacctggattgctttttgagtgtggtaaaattttatttagtaagtcatacttggtggggatcctgtgtggcttacattcatgggatgtctttctagagcaatgtttccattttcttcttcaacttttattttaaattctggggtacgtatgcaggatgtgcatgtttgttacataggtaaacatgtgccatggtagtttgctgcacagatcatcccatcacctaggtattaagcccagcatccattagctattcttcctggtgtagagcagtgttttttaattttcctgcatattagattaatctactgagcctttaaatatcaagatgccaggttgaagctcagaccagttaactcagatactgtgagtatgagactgaagcatcagtgtttttaaaacctcacagtcaagattgagaaccattgctctagagaaaatttgcctttgatttttacaggcactgtgagtgtgttttcagacctggaccagtttaatatcagtgtctcaactttgggttcctgaactatataggtagcataaatttgaaactcatgtttggggaacctttttctttctctcatcaaacatgtaggctgagatagacagattccttgtcatctctttgcacttagagagtagccctttaggggtcatgggggcaaggaagggctctgttctacttcatcaggttgagcaaacccaaggcttcattgttgattccgtatgtctgtgaaatcctgaacttcttgattaccaatattaacaaatgccctctgtgtgacttaaatgtcgatgccagtgcagcagttctatgtttatgtctttttctgattttggttctaaattcctcttacttccgtgagagctcagctgtacatttagaatctttgttatatttaacaattctcagtttttctgtgtacttacatcacactattgctagaaatagaagtcttgctatgatggcattctctacctttgtggccatgccctaccctttgggatcatcctcttttccagatgcctgcctaaaccaagtgtgaacttgctgtgtctttagacatggtgcattgggtttgcaagtgtctatctggcaggcccctggagcttgtatgtgttccttcaccctgcttggcttggtcttggctttgtcttaatccatctggtctctgttgccaaggtctaggcatgctttgaattccaacctacctgaattatgtcaacctctattctttttcttgtgtttccaagtctttgtcttcactcacttgctaaactcaggtctggtttcagtttatttcctggactcatctttccacaaaggactcgctttccctgatttgagggtttgtagcacagtttataacaccatgggagtgagtccagctcaggattcacatttctaggatgccaagatggtctgagcaaatagcttctaactttatatgtcattaaaaaaacacttgttactgagtatgtaaattccaaatactttctattatatattgataacatttgtacctatagtattaattgaagataaatgctgtatcactgattttgtcaggaagaaggataccctttacagttgaggatacacttttgttttttttaaatttgcttaattcatgtatagccatcttcctgtgtatcaaataaaaccagctgtgactggattgtggctcttgtagtccatgcaacctttttactctgagaccttggaaggaagctgagtttggtggaaagcatccagagaactcttggcagccttgatggatcatttaccccagtttggacttttctatctcttttaggaagctctgctgagatcattactgaaacatcagttttcctcagagaataacccctggtcttctgccagtggagttagcatttggttatgaagatggctttgagaattaaataagatacctggaggcaagagtgcattatgtaccggtagtgagcccacagaaatgataggttgcatgattgttggtggatagtggtctaatataatctttaatctttcatctatcaattgcatcctttaggatttgtgttaatgcccccctttcaatcattctgtctttatttagatttctcttcatattttctgtcttttctttcttggcagtatcttcaaaagtaattaggcggctgtcccagaagttgcctttgaagattgttgcaatgtgtatacctgtcaaaaggaattgaccaaaccctgctgaaagctattttacacatcaatttatgagccaatctcagctcttctgttctgagctgatcatccagaatgatccaaaaggaaaccatcagagccaatcatagtgcctggagtgattttcagatgcctttttttcttcttttacttacacagggcactcgggaatcttgcactctggatgaacccagtttacattttggttgggatggggaaagtagagctttagactttattttgaaggcaaaaacccttttatttacataggaaacatttcaattctatatggtttttttttttctctttgttttcttttcttctttccctctatccttccttccttccttccttccatcctcccaccctccctcccttctttccttcctacctaccaacctacatttttttttctctcttttggtatcttggaacatatctaaggcttttggaaaatggacattgttgaagaaaaagtgttatcactattacaaaaatatgatttagaataatggaacctcagatttggaaagaacccaaggattcctttatttcagccatttaactaatgcttaaattctttccaatctagtcacagcccatgatgggatacctacatcacctgcaagtgttgggaaacttctgtgtcctgcagtatcccttacaattttgaacagctctggctgttatttagttactgtttatgttgagctaaaatatactctcctgtaatgcctatcctctgctctttagtttcttttttggggaccataaagagcagtatttttaaaatttcaggctgaaattcagggttgtgaaataattttaattggttatgaccatcattaaaagagaagaaaaaggccagatgtggtggctcatgcctgtgatcccagtgctttgagaggctgaggcaggagggtcacttgagcccaggagtttgagaccagcctcggcaacgtaatgagcacaggtctctacagaataatttaaaaattagcttggcatggtgatgtgtatctgttgtcccaactactcaggaggctgaggtgggaggatggcttgagcccagaaggtcaaggttgcaataagctgtgattgcactgctgcactctggcctgggtgacagagactctgtctctaaaaacaaataataataaataaataaaaggagaagaagaacaaatagaacagaatgagagtagaacaaaatagaaaatatcagagtatatcacaagtagtaaagttttcatgaaacctttgtcttgattttatgtttatttaattatataattaactatgtatgtgcactgtatctcaatggtcaaaagagtttgaaagctgctgaatagaacatgtctcacttttcttccctatgccacccacatagttgagccattctcatgccccatcaagtcttttcttccctacacgaagcatttccatttctttccactcatccatatgtatcacagtctcacatttccttgccacactgaacacagttcaatgaatctagtttgtatgaaaaattgggacctggaatcaaaaacaatgtccctagctatgttctaactgaaacaggggcaagtagaactaccctgttcttggttagcagaatgcacttcactgcattttaatgcagcctgaagtgattagatcgatgaggatgtgtcacagagactccagagccagaggcccctgggctgtgtctcatagtgatgaaatacacagcccaggggcctctggctttggagtctctgtttagtcagtgtaagcctgcagataagctgaagagtaaccaagggcaagttacttctctatgcctcaatttcctcatctgtaatataagcatatttcaaatttgcagtattttataatatttttggattttttttgtgagtattaaatgagttaatacatgtaaaggacagaaaagggcatataataagcacttagcaatcccaaatatttttaaagcaatatcagcaaattattgattcattgaacatttcatcaactcagacatgtagagctttcagcatgtgtataaatagtgtgattatatgtcccattgtgcccagggtagccctagtttttacctattgtcctggcataattaatggtatcccctttcattctcaaaggctccaacagaacctcagatttgcttattccaaatcgtatttttgcagtaggaattaatattttcctcagttgtgtgccatcctagataaaagccacaacttctctcactaaatatttaatcaattttggatttacttggaagatgggatctctctctctttttttttctactgaagtttcacctgagcccgctgcccattgctatacctcctttccttgccaagtggcagaagttagcttcagactagaaactccaaaggggaggctgtcccccttgggcccaattacctgggtttaatttgcccatcattctgttctgtgaagaccttttggattctgattctgtcattcaggatatttactaatcctcaatttcatgttattttcaagtcctttttcctagggagctgacatcccttaaaggttgctttatgtcttaatccaagtaagctgaggttacccaatggggttttccagagagggtttatataaagccctgtggaagtgttaatggttgctatgtattgaacctttattatgtgcaaacaaactgcacagtatccctcaaattaggggtgttgtgaacattttacacatgtatattccctggtcaatgtcacatcaccatgagttaggtgttatctccattttaggggtgagggaagcaaggttgtcacgtaggtagtgaggcggagagctgggacttgaatccagtctgtgtggtgaggatacctggagaacagggcaccctcagaatgaaggtctgaacagaggttcttgataacatagcctttaaactggaaggctttttttctgatgtgataaaattatacttccatatgtaattcatcattctgttgaggtctcatagtccttatttaaaatatcaattatttccataaagatgaaactattaaagcagatgtggatgaggtggaactttgggggttggaggattaataatttgagggacactgtgcagttttttttcttgtaaaacatctataatgtctatttgcttttcctcatacgaatgaaagaatatgtgcacctgtgtgtaacctcctaggcaatgaaacagttggctttctgtggaatagattggtgcaccaaagaccaaagtgccttcctttgaattattttcccactttccatagatttatattcttccctatcatgataccataatcagtgagttttttattgatttatatcagacttacttccaaagagaacttgagtttatatcactttttgttgatgtatcagcaacgttaaaaatattacttctgtattactaacatagtctattactaaaaagtaggcactataatggaatatgtgaatgaattggtgaatggccaacacatattaactttaagaatgtttctctctcacttgtgttttgttgttggtgagttgagctactttgtctctttttttttgacaccaagattttttttttttccctgagacagggtcttcctctgtcgccaggctggagtgcagtggtgtgattatggctcacttaagtgcaagattcttctaagcaagatttctttttttaaaaaagttgtgatgtttgaaagaatgagtctatttcctaaggctttggcttttggagaggtctggttagcttctttgaagatccagtctcacactgactggttacctgcatgacagaaggggtagaaaacagcctttccaagggtgagacaaagacctcttaactgtcactgttagtccccttttacaagcccaaaatagttactgaagccgctagggctgggcatttgccatattaacacctccagcttttaagtggaaagactaggagacgtgagtaccaaagtggatggaagagcatttatatataggtcctaagcatatcagagggaggaaaggctaagcccatcatttgttcctggctcctcctgctgatgcctttgagatgtgagggtcaggttgcttcagcagagcctaaaacttagtctttcccttgtagaaccttttaaatttctacctaagttataattcacatccgaaagcacaccagtctttgatttaagtatttttatatttacatttattatttatttttattatactttaagttccgggatacatgtgcagaacatgcaggtttgttacataggtatacatgtgccgtggtggtttcctgcacctatcaacccgtcatctacattaggtatttctcctaatgctatccctccccttgccccccacccccgacaggcccccgtgtgtgatgttcccctccctgtgtccatgtgttctcattgttcaactgtcacttatgagtgagaacatgcggcgttcagttttctgttcctgtgttagtttgctgagaatgagaatgagaaaaaaagaatgctcatccttttttatggctgcatagtattccatggtatatatgtgccacattttctttatccagtgtatcactgatgggcatttaggttggttccaagtctttgctattgtgaacagtgctgcaataaacatatgtgtgcatgtgtctttacagtagaataatttataatcctttgagtgtatatccagtaatgggatttctgggtcaaatggtatttctggttctagagccttgaggaatcgccacactgtcttccacaatggttgaactaatttacactctcactaacagtgtaaaagtgttcctatttctccagatcctctccagcatgtgttgtttcctgactttttaatgattgccattctaactggtgtgagatggtatctcattgtggttttgatttgcatttctctaatgaccagtgatgatgagcttttttttcatatgtttgttggccgcataaatgtattcttttgagaagtgtctgttcatatcatttgcccactttttgatggggttgtttgtttttttcttgtaaatttgtttacttccttgtacattctggatagtagccctttatcagatggatagattgcaaaaattttctcccattctgtaggttgcctgttcactccaatgatagttttttttgctgtccagaagctctttagtttaattagattccatttgtcaattttggtttttgttgccattgcttttggtgttttagtcatgaagtcttttcccatgcctgtgtcctgaatggtattgcctaggttttcttctagggtttttatgttttaggtcttatgttgaagtctttaatccatcttgagttaatttttgtataaggtgtaaggaaggggcccagtttcagttttctacatatggctagccagttttcccaacaccatttattaaatagggaatcctttccccaatgcttgtgtggcgttatttctgaggcctctgttctgttccattggtctatatatctgttttggtaccggtaccatgctgttttggttactatagccttgtagtacactttgaagtcaggtagcgtgatgcctccagctttgttctttttgcttaggattgtcttggctatacaggctcttttttggttccatatggcatttaaagtagtttttttctgattctgtgaagaaaatcaatggtagcttgttagggatagcattgaatctataaattattttgggcagtatggccattttcacgatattgattcttcctatccctaagcatggaatgtttttccatttgtttgtgtcctctcttatttccttgagcagtggtttgtagttctccttgaagaggtccttcatatcccttgtaagttgaattcctaggtattttattctctttatagcaattgtgaatgggagttcactcatgatttggctctttgcctattattggtgtataagaatgcttgtgatttttgcacattgattttgtatcctgagactttgctgaaactgtttatcagcttaaggagattttgggctgagactatggggttttctaaatatataatcatgtcttctgcaaacagagacaatttgacttcctctcttcctatttgaataccctttatttctttctctttcctgattgcactggccagaacttccaacactatgttgaacaggagtggtgagagagggcatccttgtcttgtgcctgttttcaaagggaatgctttcagcttttgcccattcagtgtaatattggctgtgggtttgtcataaatggctcttattattttgagatacattcaatcaaagcctagtttattgagagcttttagcatgaaggtgtgttgagttttatcaaaggccttttctgcatctattgagataatcatgtggtttttgtcattggttctgtttatgtggtggcttacgcttattaatttgcatatgttgagccagccttgcatcccagggatgaagctgacttgatcatggtggataagctttttgatgtgctgctaggttcggtttgccagtattttattgaggatttttgcatcgatgttcatcaaagatattggcctgaaattttctttttttgttgtgtctctgccaggcgttggtatcaggatgatgctggcctcacaaaatgagttacggaggagttcctctctttctattgtttggaatagtttcagacagaatgataccacctcctctatgaacctctggtagaatttggctgtgaatctctctggtcctggggtttttttggttggtagactattaattactgcctcaatttaagaacttgttattggtctactcagggattcgacttcttcctggtttagtcttgggagggtgtatgtgtccaggaatttattctagattttctagtttatttgtgtagaggtgtttatagtattctctgatggtagtttgtatttctgtgagatcagtggtgatatcccctttatcattttctattgtgtctatttgattcttctctattttattctttaatagtctggctagtggtctatttattttgttaatcttttcaaaaaaccagctcctggattcattgatttttttgaagggttttttgtgtctctatctccttgagttctgctctggtcttagttatttcttgttttctgctagcttttgaatttgtttgctcctgcttctctagttcttttaattgtgatgttagtgtgtcaattttagatctttcctggtttctcctgtgggcatttagtgctattaatttccctctacacattgctttaaatgtgtcccagagattctggtacgttgtcttggttctcattgatttcaaagaacatctttatttctgccttcattttgttatttacccagtagtcattcaggagcagattgttcagtttccttgtagttgtgcgcttttgagtgagtttcttaatcctgagttctaatttgattgcactgtgttctgagagactgttttttatgatttctgttcttttgcatttgctgaggagtgttttactttgaattatgtggtcaattttggaataagtgcgatgaggtgctgagaagaatgtatattctgttgatttggggtggagagttctgtagacgtctattagatgtgcttggtccagagctgagttcaagtcctgaatatacttgttaattttctgtctcattgatctgtctaagattgacggtggggtgttaagttctcccactattattgtgtgggagtctaagtttcttttgtaggtctctggtaactttctttataaatctaggtgctcttgtattgggtgcgtatatatttaggatagttagctcttcttgttgcattgatccctttattataatgtaatgcccttctttgtctttgttgatctttgttggtttaaagtctgttttatcagagacgaggattgcaaccccttctttttttttttgctttccatttgcttggtatatatttctccatccctttattttgagcctatgtgtgtttctgcatgtgagatgggtctcttgaatacagcacactgatgggtcttgactctatccaatttgccagtctgtgtcttttaattggggcatttagcccatttacatttacggttaatattgttatgtgtgaatttgattctgtcataatgatgctaggtggttattttgcccattagttgatgcagtttcttcatagtgttgatggtctttacaatttggtatgtttttgcagtgggaggtaccagtttttccatatttagtgcttccttcaggagctcttgtaagggaggcctggtggtgacaaaatctctcagcatttgattgtctgtaaaggattttatttctcctttgcttatgaagcttagtttggctggatatgaaattctgggttgaaaattcttttctttaagaatgttgaatattggtccccactcttttctggcttgtagagtttcacccaagagatccactgttagtctgatgggcttccctttgtgggtaacccgacctttctttctggttgcccttaaaaatttttcctttgtttcaaccttggtgaatgtgacgattatgtgtcttggggttgctcttctcgaggagtgtctttgtggtgttctctgtatttcctgagtttgaatgttagcctgtcttgctagtttggggaagttctcctggctaatatcctgaagagtgttttccaacttgattccattctccctgtcactttcaggtacaccaatcaaatgtaggtttggtcttttcacatagtcccatatttcttggaggctttgtctgttccttttcattctgttttctctaatcttgtcttcacactttatttcattaagttgatcttcactctctgatatcctttcttccgcttgttcaatttggctattgatacttgtgtatgcttcacaaagttctcgtgctgtgtttttcagctccatcaggtcatttatgttcttctctaaactggttattctagttagcaattcctctaaccttttttcaaggttcttagcttccttgcattggattagaacatgttcctttagcttggaggagtttgttattacccaccttctgaagcctacttctgtcaattcattaaactcattctccatccagttttgttcccttgctggcgaggagttgtgatcctctggaggagaagaggcattctggtttttggaacttttagcctttttgtgctggtttttcctcatcttcatggatttatccagctttggtctttgatgctggtgactttggatggggtttttgtgtggatgacctttttgttgatgtttatgctattcctttctgtttgttagttttccttctaacaggcctctgtgctgcccctccttccaccaagctcgagcgtcccaggtcgactccagactgctgtgctggcagcaagaattttatgccagtggatcttagctttctgggcttcatgggggtgggatccactgagctagaccatttgcctccctggcttcagccccctttccaggggagtgaaccgttctgtctcactggtgttccaggcgccactggggtatgaaaaaaacttctgcagctagcttggtgtctgctcaaatggctgcccagttttgtgcttgaaacccagggccctggtggtgtagggacccgagggaatctcctggtctgtgggttccgaagaccatgggaaaagcgtagtgtctgggccagagtgcactgtccctcatggcacagtccctcacagcttcccttggctaggggaaggagttccctgatcacttgtgcttcctggttgagaggacgcccccaccctgcttcggctcaccctccatgggctgcacccactgtctaaccagtcccagtgagatgagctaggtatctcagttggaaatgcagaaaatcacccgccttctgcgttgatcttgctggaagctacagaccagagctgtttttatttggccatcttctatttacatttatttttatatgtagttatatatttaaaactttatcttgaccacttgatttagagtaatggaaattggagaaatgtatacagtacagaacattctacattggctttttttttcctatttaaaatgcttaaacgttctttaactcaagaactttaattttgctaataacaaagattcttaagcttagtgtgaaacatggaaaggaaacgccagcagcctggttatgaataggatcagcagtgccatcttgtggtaaataccttgaattacaattagaggcacccgcatgggatctgggagactaagaaattctactctatgctcagtgatttacatagaatgtaaaaggtatttctcaccattttaagactttgggtttatataatcagaggaggttcttcctttacaaatgtggcaaagactacagttttctacaagaccttttaatgttgagcttttaatgttacatacaattacattaaatgttactgtatgtaatattaaaaactacagttataatttcaaaaagattatagtacatgaaacattttctctagcagcagctctaatgtgtaataaaacctagtattataggttaaattggatatatctataacataataaggtaagcagctatagataagtcaaagcatggcaagtatatgatcagataataatcctgtttccttcagacctaacatgtggtaatacagtaattttgtgttctttagcttgtctgctgcttttgaaaattcttttcaacagttaacaaatattgatgaatccaactggaaaaaataatgtttacctattcattagttccaagtctgtgatagttaaatacgtgggaccattgtagtttctagaataattacatttaaaatccccagcaccttgcaaaaatatttattcaattcatattttgctttttacgttatcaacacatattagtttagagagtttagcacaaatcactaactagaccagtattagtaatccattggtaattccaagtctcacactggatcatcttgaaaatagttcatgggttactatttttttcattagttatatatgtcatgccgaatcaacattattttcagaagtcattcctctttattttattgcccttttgtgtcactttctttttcaaattataaaagtaatatatgttcatgatgcaagttcagatattaaagtaatcattcctgataaacttaacccctggaaataatcaccatttacagtctggtgtattattttcagttgctgcatttattaataaaaatattttctcttttcagttggtcagaggtaggggcaccccatcttcatttccctcagtggcactttcttccagaaaatttgctgacaatatgttttttttgtctgctaagataactgggaatttcattaccctgataggaaattttgatttttattcctagttttgctgtttctcacttcctgcagtgttggatttattgggcactggatgacaacactctgtagtgctatacagatttcctagcatgttcagatatacattaaccatgcatagaaaggttgtagaaagcttaatgactttgcccaagttagctaacatgtgactagccacgatttaaatcccttctgattatacctgtacctaggtgaattcttctggtcccatgactttaaataccatctgtatttgagatgactctcaaatttgtatctttagccctgccttcccccctgagcatcagacttgtatatgcaatttaaaaaaatacatctccgcctcagtgccatctcaaaccttgacttggcaataaagagaatgcttgatgtcctcaccgctaccttttttctcccaaagacttctccattttagctattggcatcattagctatccatttgcctaagcacaaaccttggaataacctttggtttttctcttcttcaagcgtgacatcaatccatcagcacatgctgattctaactacgtttccctaacataagttcatctcttacctaggctaacataatcacatcccaattggttttcctgcttcccctctgtctgtcatcaccattatgtgctattctattacctttttatttttttcattatatttaacaatatctggtattattggcttttggatctattgtctgtcttactttccttctagaatgtaagctctgcaaggcagaaacttttatcttgtcaccactgaatccccaagacctagaacactgctggcaggtaggtttcgtgttgaacctgtaaacaaacaaattaattaatagaagaagtctggtgcttgttcagtagttgggaattcaggaaaattattcctttgctggttttctcagcgctgttttgtatagcgttgaaagaactgaaaaacttttatttaataatgtgttcttgagattgatattagagtcttattatcttagatatacagtatcacttaggccttgctgaatgcattttatgctccctgagatctttttgggagattttctgtggaaacctgaaaaggaaaccatcacagtgctttctcagagaagcaaggctcaacaaatgactgggaagaaacttttgctggttgagagaggtattcagtatgtgcttcaacaatgatgtaaaagggaacaaagagaagtgaatgcaaaacatctttatttgctttggactgcccttcttccactaaggctaactttgaataaagaggaactcgataccgggccaatgaataaatttttaaaactggaaacttaaaatgaaggtttgaggatcctgaaatactatatattttaaaaaatcaatgattcttttaagaaatggaaaacaaagtgagggaagagtgggtagagagattgattggtcattctatatctagtgtaatggaaaaggtattttgtgtcagcaagatctgggttttgattctagtcttgccactagctggccacatgaccttggatgtcttgcttctgaaatctaggcttgttatttctgttggtggtttaggatgatcacatgagatgaatcttgggaaataattcttacaattataaagcacaatacaagtgtaatatattatcctgattatcattatctcaccattctagtatgaggatccagggcttcattctcttgatgttttcaactttgtggtcccagaactccaatggctacaaagatgccaagatctgaactcagagattcatgaaacagctctaaatagttttaaattacttccttgggaaatttttgcttgcttatgtgtatctgagattaacaacagtaaaaacaccttttatatagcaccatcagtgaggctttatgtctttattataaattttggagcatcctccaggctctcaaaatgaaatctctggatctactgaagagagagagagagagagagacagcaaggactttcatgtctttaaaagcaattacaggctcaggtctctgaaaaagtattaagtgccaagactgacgcctctgcaaccatttattcttgacattttttcaacttttttttaagccagactattgatgcattttaataccattagtatttgttaaaattagttcagcagtattattaatttgtcttcttaaaataaaaggcaggaaaacagtattatgcatgtatttaaataagtcccctttccagatattggaaggtatgtttttaagtattctggagaaaagtcattttaaaaaaatttccaagcagaccattttgctttagaaatattgaagatgcaatatgtgaatcatatttggattttaaagcaggatattaaacttcacagtaaaaatgattccatagttgttaaagtccaaagagaggtttacgaagccagcagacagagaaactgaaattcacttggagaggtaaatgacacaggaatggaaacattgaataaataactttacagcaatttttcttgatgttattttatcccttaaaggcagacagatcattaaaattaaaattgtattaaaaatattctctataaaaatatataacccaataaaatgaatgttgagtcagccacgtgtatttctttccaaacccataatttggatttggattggatttccaaacccacaatactaaatttatttagtattttgaaattcatatttgctaggcagtgcatcttagtaaattaaaaaatatatattcccattacttagttcatgtaaataatcctaaaggtgaactgaattggccttactgaaatggaggctcatgccagggctgaccagggaaggtgaagagaggataagagacattttatcttcatgcatttgtgtctttgcatttgctgtttctctcctggatgtgtttcccatcctgggtcatttgcttaaattcataccaattttttttagcatctatttcaagcaccctgttctccactatgacttcactaacatttctagatagatagttgctcctttctattgctgccttgtatgtaactctgttattgcatgtaacacatcatcaataatttgcttacatttctgtagcttttgtatttccagtacctaccttagtgcttgacatatagtaagaacttaataaatgtctgctgagtgaataaataaaaaagtgagtgatagctcctgatcactgcataacatagatacaactcataaagttgtgattcctggcctcatccttgtggggcaagtaggggtggtgggacagaggctacccagaagatgaacagagggatgggttgattatgcaataaaaaacattcattcagcttctggcactgtgccaggtgctgtgggggaaactgcagagatgtgaggtacattgtatctgctttcaggggtttaccagttaggtttaagggcctaatttacctgtatgaatcatctagagggaaattgaaggctaagttgtaagacttgactgtgtgtctatgaggaagttagaaaagttagaaacccacatgagttgaaggagcttggaaaggcttcatgaggagccacaagttaatttgggctcagcagtattgactgaaggaagggctgatgaagtggcaagccttgggctaggtgggagttgaatgggtggctgtgtgggaattggcttgtggagcagtgtttactctgggagaccacagacactttctacacctatggatggattttagagatgctttgaacccctggaattatttgcaaaatgttgtatgtatgtttatatgagcagttttccagggagaattctcagctttgaaagaagtagatgcagattttaaaagaatgttacgttttgtagttgtaatcacgaataggtagcattatcattatttatcttttcatgaagtcttaaagaaagggaaaaaggaagaattcgatggggtagggaggtgaagggaggagggagattcaggctaacaatataggtatcaatatttattaaatgatctttccctgaaagtgtatcactaacatgctgtatctttagctgattgtcaaaagagatcatctaagcgatggaggctacactgcctgtttgagagaaactactgaactaaaagtgaatgaaaatgtatcccattgttgcccaaatgaaaatatacttaattcaaaggcagaaataatttttaaaaattgttagtgctagaaagatgaggtacttataaaaaaaaaaaagaatgtatttcaaccagatcatgtaaaagtatgcccattctcccactgatttttcttctacttgttaatagttttgctttttatacttagcacgttagcatatttgaagtttatgacatcaagtagtgactcaagttattttaatggaaagcaagtcatgttaagatcacttcttgaacaacttatgcttttgtcattgacatgatatgcctaattgaggtttatgttgtatatatcctgattggggttcactgagatttttggatttgtagattaaagtataaattaaattttggaactttaaaaaataaaaataaaaaataaaaataaaaattgttagtgctttaaccagcaaacattattttttaaggattattctatttaggtttttgaatgtagggatttgcctcataatgaaaaatctgcatttcatcataaaaactgaataaaatgaacatgacttggttatttgccatagatgcggattcttttaatattggatgctcagtttgtatagaaaacatttggattggagcccctctttgggccattgccaactagaggttaacatactaatatatcagagataggagtgatggatttctacttctgggtgagtgttacgctatcacatgccctgaagtgatagctctatcatgttgcaattgtgagttaaggaggaaggaaagagatctatgaaaaaataagctgttcctttgtttcctggcttgttccaaaaaggattgcaataaaaaagagtttcatattattggtttatgtaattgataagagcccagtaattgaggaacaaaaaagttgttaagtttatgcaaacgaataatacaaaagggattttcccataattctatctttaggagagtaattaattggataatagttaaagaagatagtaatgttgagagaatgaataggtatataaacctcaattatatcttaaacattagtaagccatatttttacatagaattcagtttaattggaggacctgagaaatttgttgacactggaaacttgtgcatttttgatttataaacctgaaatatgcataactaatgttaatttaataatgttgaattttaatagccttaaagtcaagcattaagaaaaatgctcagatcatacaattttatgaaaaatagactattcaactcttaatgattcaacataaagggccacttcagtgaatgttcaaaatgtattatcacttctgtggtgatctaatcttatttattgaatctggtaacatatatttatgtatatatgaatatgagaatcttaatatatattttaatatatatattattacattattctgtgtaatatactttttgagttcttaatatcttatattttctataaagtcatatatgtggcagatacatatatggagatatttcagattattgtattgcaagctgaggaatgtagtatcttcagaacttgccacttgctagggacgaggttggaatgagaaagtgtattggcctcatggccattcctaagtcttggggccgaaggctggaggttggccctagtgaacaaattacttggaggatccagaagtggctagtgcacaggagacagtgcaatccattcccaatggggagcagtgggtcatgactggatgaaccatatacatcatcagttctgaaaatgaggctgattaaagggcattcaggagcagggtgaatgaagcttctctggggaaggagagaaggtccaggcctttgtaaacaggattgagttttctaggttgcccagtcccaggttgactttggctggaattaaaagtcatggttcaggtagttcaccttttatagtttcgtgcttattaacataaatttacttttattttgaatacattttgctataattagttaaaacaattatagtaacaagatgcttaactctcactctataaacaatagcattatgaagggaatatggaacaaacaacaatctatttatgaagaacagatcagtggttgcagctagggtgggagcagtgactataaaggggtagcaacaggaagtttcttggggtcatggaactgttctggatcctgatagcggtggtgtttacacacatctatatgcattaaaattcatagaatcatctgccccaaaagtccatttaactatacgataattgtttttaaaaagcaaaaaatgctagcagggagataaaaaaaatttttttttttttttgagatggagtctcgctctgtcacccaggctggagtgcagtggcacgatctcagctcactgcaacctctgcctccgaggttcaagcaattcttctgccccagcctactgagtagctgggactgcaggcgtgtgccaccacacccggctaattttttgtgtttttagtagagacgggatttcactgtgttagccaggatggtctcagtctcctgaccttgtgatctgcccacctcggcctcccaaagtgctgggattacaggcatgagccaccgtgcccagccagaaatgtttaatatatcaaatatacacaacagaacaaagtaaatcctaacagtcctagaaggctataggaaagccagagtcctaaaagtatgccatttgcctgtttctgaatgtcttaggttggtggaaggcacattttacctggaagctgaaaatgatttggtcccctagttcttcttttatcttgctttcaaaaatagacctgtcttccttcctttcttctttcctccctctcttctctttctttcgatcattcctcccctccttactctctttctttcttaagttcatgctatctgacatggtgaagtggcattctagattactttttttttttttggtcacaagtgcctactggtggaagggacatgaagggaggatgagaagctggtctagctctgctccaatcctgagggtggacagttgagccagaataaaaccaaaagtgaagcctcactgcttaccagaatacacttgtgtagtgcctacactacctgtaggccttcctgtttcaggcagtaaagtgttgttctggagctgagcacctgctttgagttagaattgagacaggcaccagaagttggatgcagtccagactgatcagaggacccttggaatagactttaagttgaccttgaccctttagtcttctttggattggacttcccaggattactctgtccctttgaaaaaatatatttgtgtcttgggcctgaaccaaattttaatcagtctcctagaaattgtgaagggctgctatggcatggcacaacatggcctgttttctcaatattgtctctttaacttctcatttacttggcaacctgatttctgattttctgaatgggtgttgctgtggacatttgcccagaaaacagctctgagtgagggactatcagagagaattttatgtctcttgggaagggaaaggttaacttttatttccaagaggactggctgcatgagttcttggatgcagcagtccccaggagagtgcggtgtgttgagctgtggctagtgtgtgtagttccacacaggcaggagtgggctgtgcagagctacttgtttacaacagcttcctgaatctgctaatgccagactgagtgaatgaaagattagtttgaagttcttgacccatattctttacattaaacattgatgaccattttttctttcagtccttcctctatgttattctggatttgaaatctctagctatgagataatattaactgaaattcttgacatttgccaaccctagtcacaacccttgctatagatcatttcaacataaagcatttgtcttttagcttgtctgaaaatatactgcagtatgttgctggtggtaatggatttcttggagttgaaccattgggtagaggatttgtgattggagtttaccatctgatttatatgttctatggtcatgataactcagatttgcagatctgggtactactgggactgtggggctattgtgcctgacttaattgcatatttaaatgtaaggctagaagtaaagctgaaaaagcagatggatttggaaaatgagattgtcctgttttgaggtcatatggaaagccaagaaattgctggagcagctctgacagggatttcaggaaaacaggctggtaatatttccacttctctcagcttgcagtctggctgaaaatgtagtaagatcagccttttccaaaggtcttggtatttctgcagctgttttcagaaagccttgaaagtgaaaagcaaaggagtccacagaatctcaagtatccatgctccaatcactaaagctcttggatgatctaagtggaaaagagctgaagccatgtaagtgaaggtgtgtatgacacagttcatgtgtggagtctgctctttcagatatgacatcatgtctgtggcccccaaaagcttccaggaaagcatcggcttgacagcgaggatgccaaaaagtccttgataggagctctgcacattatatttccaccttctattattttagattcttttttgttccattcacctaagtcagctgggccatctgcctaagccagccaacatctcacattttctaattggtctagttagtccagggttaatatgtcacttactatcactaatgagagactgtacttgctagactcgtaaagcatttttaatgaatgcttccagtattatgattcctgttctacagaaaaagaaaccaggtttcagagaatttatgtgatttgtacaaattatttgaacagattagtggatcatgagggctatggaatgtatattttatactgtcagccaccaactttcaagtggttgaagctctccacatatgtaatgtgtttaaaaggaagtttaaaataatagaaatgactagattgtgtcagtgatttttaaatattctgcaaatgaaacttaagtaaaagttcaatatgttaaagctacaagttctattttagcatgaatttatttcacaagttcaggtttctaataactacttatcttcaaattaaccagtaacattaacgaagctatttatgaacacaagtatttgaaatctagatttgtagatgtgagttggagccttaatatctaatatattttaaagttttgttcggttgtcccccactgaaaaaaaaaactgatttacagataaattcttgaaaataggtataattttcttaaaagctaagcctactgaaaatattattcaatctgattgaatcagacacttgagaaattattaacaggtagttttggacccactttgaatcactatctaactatacctgaaaatattcatttttcctcttctctcctaagcccagtccaattaccatcctctgaaacagcatttgtcaaggtccctagacctctgtgtagccaaatctgtccataaattctcagttctcacttcatgggacccatcatcagcatttgacactcttgatcactccacttactctccaaggctcgcgctctcctggctttcttcccatctcaaaggccacttctcagcttcctttctgtgcccccgtcattgtcctgactatctcaaactccctatcagtccttttcaaccatggtttctcatctgaaccaaggacacaaaaaatgattccagagaatattttctcaactttttccaaggaaaataactagttctaggtgcataggaaggaagttaatccatcacatacaatgggtgccttagggctttgtcttaatgtttcttcacataacctcagttgacaaaggttgccagcctcaatccacaaacattaggcatctgatgcattttcatgaccttaactccatctatatattgacaactcccaaatttatatctccagcccaggcctctatctgaacacaagataatgttctctccaatttgatgcaacctcttgtaaatatctgacatctcaaacttctcatgttcaaaaacaaaacccgatctttcccccaaaaactgttccactcagagttgtcatctctcaggccccaaattttagtcatccctgaacttctggtctttctctcacatctttcatccaatcctttggcaaatcctactgtacctatgtttcaaatacatccagaatctgaccaattcttgccacctttacttctaccaccctgacctaagccacatcattctctagagcttgaactattctagttgcctcctaattggcctccctgctttcattgttggacctctacagtctatttcaaacacagcagccaaattgatccagtcctttgctcaaaattctccagtagctcccaattacaatatgtatggtaaaagctggaaaccttacaatggcctacgtgatctgtagtgcctctttcctgactgctgcagtctttttgctgttcttacaatacattgagcaacttccacccagggcactttcccctgctcccgccccaaacccccatggcttactgctcatttctttcaagtctttgcttagatgataccttatcagtgaggcctttccctcccaaccttttaaaaattgtaacggccctaatcactcactatccccattccattgcttatttctccctattgtgtttattattttctaatattttacatggtttgcttatttatttttattgtcttccttttctactagtgtgcagtttcctcaagggcagagattttgtccatcttgtccactactatatgccaagtgtttggaacagtttgcacggaggaatggttcctgaatgaattgaatgcatggtgagcgtttaatttgaaatttgaaatgtgattaatggaattttaatcattttaaattctccttgtattgcacaaaatgcttcttaaatgcacgttgtaacatcatgagatagtcaatccagatacctcagtgcccactcctgctaaatatttactcaaaggttaaaaactgtcattggttttgtatgctgaggccaaatttgaatttttagttgcgtgctggtacttcatctgcagatgtaggtatcatgcatttcaaccctacattgctaggttaatctaattgagtatattgaaaatatcagtaggattccaagtatctcagttctctcccttccccactgtactctgtgtgagttgtagcggggctggtccctgcaggttgcatttctcttggttgggcatctttctgtctgtgttgacctaattgcaggcagtaatgcatgatgagaagcagcttggagaagccagggtattttcccctccttgtctgctgctgtcagcttcctgccatggccacagcttctgtcaaatgattccatcctagtgtgtgagccagctcacaccagttcatgagggacaattttgtttatttttttcaactccacgtttatgtttttccaactccatcaatatcacattgatgacttaaaataggccaaatcctggctttccactgacagagaaccaatttgttaaacattgaccagcacaccctggtgggctcagcccttgcgttctgtaacacccctttttccttttctctctggtctaggagtggtagtggcttccaactgttgctagtccctggcttattcactcttccctgtttaggactcaattccttggtcacctttgtaaagaatttcctgcattaattctcttcccttttagaaacaggaaatgatttctgttttcctatactttgatacaatgcctaaaatagaacaaccatgctatgtttgagtgaacttgagagaacctttagcagcaatacaaaacaaaaatctttgtctcatctgaaatatttgcaccagtgccttgccttggaacacataaaaatactttgatacaaaaagtaaatttctgatctcattgccaaaattattacacattattttgaaatgctacaacttaaagacagcactctaatatagttaacacttaacatgacattatccaatatagttttaagagatgctgccattttgttacctcctaatacttgtttctgaagcttataggaactacttgaatactttttttcaattgcttttcttataagtcattttcagttgctttcctatggcttactcatcatttgtagacttggtcacgttgtgaatgagttacttcatggtatgttcaaagtcatttaaatatctccctctgttttgatgtatgtattgagtgtttttcaaggctataaactcccttaggtttggccacaggaacaaagtgtacaaaaatggagaataggaagaactataacatccatactctcatttagttgaattataaagattttagctgtcttattcatcacatatgttggatgcccagtcttgggtgctgtgagctgtgatatctgacaatggtaccaatatttcagaggcagggaagcctggtcatttaacacattcactgtggggtcagtagctcaggaggtaatagggttcacccagtgtgtttccttcacatgtgttgatgtaacttaccctgaacaatgtttttaaattcatttttaccatttaaatactactggtccagactgagtaagcatccttgaaactatattgtagtcccatctacagtcctacatcaaggcttgttccaaaattgctccaggtcgtagacttggactttaactccatctttatctctatgcccaccttacagagtcctctaaggaatgttctagagagcccatctttctgtataatcagtctatttagagtggagcaagtgatgaaatttaatgtgaaagattccttgattttcatattatcctattgtctgaagattctgatcaatctaataaatatgcaggttaggcctagtctggttttctttatccaggatcccttctatccccagctagagccactagatcactaaatcaatcgtatgtgcaggctgcctctgatttatttccctcgctgctgctggcctgcccctgccttttagccctgattggaatgtttcaatgtttgctttgttctaatactctgtcccttgtactctcttttaaataaccagcctctgactgtcttggttcttgtttacccaccttttcatcagccccttcctcattcttcaagcccaaattccagcttgaagtctgggttctacaatctgttgacagacttcctcgaagcttatgatctgcattcctgaccttcctaggagtgtctacctcacaattttctgatgttatgttgtgcaatgacacctcattttgtttgtttttgctgttgctgactggaccattgtatatcagatgtggtgttttgcctgccagaccaagccttcccgtattgcatgggagtatactagtggctgtgaccagactgattttaagttctaatccctcttcccactcctaccctcaacctgctcagacctgacaaagtaatagggaattgcccacccatttaagtcccataaaaagccatactgcaccactagccacttcaattatgatgagtggttttatgggaagaaaggaattgtaggctgatgatagtagctttgttgagttggtagcactggatccagtctctgagggaaacataatggttggatttcaactttgtagtattattccaggagcatctgtatagtatcataaatatgggatctcacatgacgtcttcctgtgtctcagaaaaatggacagaaagcaggtttcaataatcttttttttttttttaatttgactttaagttctgggatacatgtgcagaatgtgcagttttgttacataggtatacgtgttccatggtggtttgctgcatctatcaacctgtcatctaggtttgttttttttttttggcagagtctcactctgtcacccatgctggagtgcagtggtgtgatctcggctcactgcaacctctgcctcccgggttcaagtgattctcctgcctcagcctcctgagttgctgggattacaggtgcacaccaccacacttggctaatttttgtatttttagaagagacggggtttcaccatgttggtcagactggtcttgaactcctgaccttgtgatccgcccacctcggccttccaaagtgctgggattacaggcttgagccaccgtgcctggcctgtcatctaggttttaagccccacatacattagatatttgtcctaatgctctccctttccttccccctgagcccctgacaggccccggtgtgtgatgttccgctccctgtgtccatgtgttttcattgatcaactcccacttatgagtgagaacatgtggtgtttcgttttctgttcctatgttagtttgctgagaatgatggcttccagcttcatccatgtccctgcaaaggacatgaattcattcttttttatggctgcaagattaaagaatcttttgcaacagatggggaaattgagatttagattgatcaattgttgcccttgagatcacacacagatttgttgataggatagatcctaggttttggttttggggaataacaatccactgtcccagggacttccaaccatttgatgaaagaatggtttttagttctctgaagccttaaggtaatttaatttcagagctggtctggaactgaccttggagattgcctggttattagtctaaaccctcattttcaaggtactgatgacagagaataggaggtgtgttccatttccctaccccggattgtatgactgatgggaatggagaggtagagtaggacagaggtgtatggtctatcaagaaaggcttgaagtcctctctcaatcttttgtgcaaccagttttattaaatggatggaattcaatgggaagtgaaatagggaacaacctctacccaaaatcccaccccaccctccactgccttcaataatgttaggctcttaatttttccatttttcttttttaaaataatattttattggccgggtgcagtggctcatgcctgtaatcccagcagtttgggaggccaagacaggcagatcacaaggtcaggagttcgagactagcctggccaatgtggtgaaaccccatctccactaaaaatagaaaaattagccgggcatagtggcagccacctgtaatcccagctactcgggaggctgaggcaagagaattgcttgaacctgggaggcagaggatgcagtgagctgagattgcaccattgcactccagcctgggtgacagaccaagactccatctcgaaaaaaataaaataaaataatattttattgttttttgcataatgtctttattttgcagaaaatgctttctgcttattgtctttggctactttgtcaaaactctaggtatgtcaactctagctatgatacctgacacaaaagaagcctgaacattacttgaaagcaacaaggaagagaatgaaagtttgttttttatctcactaaagtaggaccattgtttacaaattctggtatgccaaagtcatctatatgctatatgagaaacaaacaagaagtttctggaccctagtgaacagttttttttttctgtgagtcatggtgaattacgcccaactgcattgcttccagccttgaattcacctagatgactcaggacaacactgccactgcagattaccagcaaagtgggaggtggtgatgggactttttgataaatagtagaatatgtattccttcttctattttaaaatgaagttaataaggctttatttccttcctttgacccatgcgactgccattttatacctagtagatccatcagatgaacgctggttgcaaagtcattgcatatttcaagacataggtcttgattcacatggaaggtggtgacatggctgtctatgaggctaccagtaaggttgggctgaggcattgtactggctgtcaggcgtgtctgtgtctgtgacagtcccttcatacagtggggatcctagagctagtagatggattggtgttatgactcatggggcacatactgatgtgggcaggcattcgaggctggaccaactgacaggggattggagcatggataaacacacagatgaattgtcagaattgtaaggctcttgtatcggtttgaaccctgaaagcgcaccaacgaacaacacaaggcggtgtggagcaacacgctgttttaatgtgtgcctgggtgcagacgggctgaggcttaaaagggcatcagcaccaaatgcggacagggtagcagttttatagtctcctgtaaacaggaagtatctcagtctgatgtaactgctatgcagtacctggacagcagtacctctctcggtcttcagggggtacatgtcttccggccagttctcttcctgcttctgccatcttgctgacaaacactgttggcacaagtggtcttgtgccttgggactaggcctcagaagtgaggagttattcaccaccacctccccccgccggcttccaggccctggggaaagtctttcattcttgtctatttggttatagaaaaagggaaaagcgacgactttctcaataactacttcaagcgtgacatagggggtggtgtggccaccttggaaacaaaaacttaattttgggggtatttttgagagatgggttggtattcatcatgtcgttgcagcaggagcatcgtctggattgtctggtggttaactatggtttcaacaagacttttattagcttttattattagtgggataatacaggggagaaacaggaggagcccagtgatgaagattactgtccctaccagcattttaaatcctcttaaattagagaaccaccctcctagaatgtttgttgggtcccatcccttccaggtttggactggtacatgggctacttttctgatgtttgaagcgatttatagtactgtttttccattatcgtctatgttaagacaacaattggagatattaaacttaccacaaacctcaccttctgaagttgtttggaactacccacctggagaaagtacagacaaagactagaagatagtggagctgtttatcgggtgggatgtgagtgaagtctacttgccaatcttgcccaggtacctgtctctgggcttggtgggtaggaaaaggcagtggctggagggagccctggggtgacactgagtggcagatagagcaggactgggtgatttcttgaacacagctggaaaggtgaggacaagtgagaatagggcggagaagttgtaagagaggtttggaactgacatggaaaagttgtggagactttgggggatagggattgtttgagagtgaggaagaacgaagcgcccttccttgacctaccatggtccttgcttttgaaggttttgggctcagaagtcctccttttcttccgaggattaaagaggagagaacaaggacagggacaaaaactggccttgcacaggttgtaggtgtacttgtttggctacctaatctgctagtgcatttccagctgctataggatcgtatggagtttggtggcctctgcaatgaatgatggcaactttctgtgggagcctggcagcttgaaggagtttgttgatgagagagccatgtatgacaggagtgttttttgcagttaggaaacgctgttctttccagatggaagagtgtgagtgcactatgtggaatgcataatgagaatttgaatatatgttgatctgttgtctggctgctagagtgagagcttgagtgagggcaatgagttcagctttttgggaggtggttcttagagggagcatattggcttcaatagtgtgtggggggtgacactataaaatagccagcatgttggtgtccttgatgtaggaaggagctgccatctacaaaccaagtaaaggaggcatctggaaggtgttggtctgttaggtttggaaaatgtataagaaatgtttgaacagtgttcacacaggagtgcgtagggtcttgggtggttgtagcttcaggtaagagtgtagccaggtttagacaggagctggttagcatggtgatgtggggagtttctatgaatagagcatagagttggaggagctgttgggcagagatgagacttagtacactgcagtgagctagcatgtctttgatgttatgggttgaataaactgttaggttggcatgaagagatagttttaagctttcaagggtgaggatagcagctgccgccaatgcttggaggcaggcaggccatccaagaactgtggcttcaagctgtttaggcaacaacctggaaggtgggtcccttagactgggttagaacacttattgcaactccacatcattcattggtgtagaaggagaaaggtttggtgaggtctaggtctgggagagtgaggacgggggctgaggcgagagccttctggagtagacggaaaggttaggtaataggcagtgcagggtttaaaggctcatggagagggcctttagtggcttggtataacggtttggtgagtagagtgaaggagggaactcagagcctaaaatatcctgctagtcctagaaaagagataatttcttgcttagtttgtggaggtgggagggactggaggagggatatgccatcggttgtgagccctcgggtttgcggggtaagagctaggcctagataggtgactgggggggtgcttatttgtgctttcttaggggagacctgatgcccccattctgccaagaagtttaaaagagagatggtatggacattgcagtctctttgagagggtctacataggtgtagatcatcaacatactgaaggagagtggatggttttagggataaggtacagaggtcacgagccagggcctgcccaaaaaggtgggggctgtctctgaaaccttgagttagtatgcaccaggtaagctgatgtgaaaggtgggtgtcggggttttcccatgtaaagacaaagaggttttgggaatcagggtgtaaaggaattgtgaaaacagcatcctgtaggtctagaacagaaaaacaggtggtgttggagggaattgcagaaagtaaagtatatggtttaggaactactggacatactaggggtatggcttggttaatgagcctgaggtcctggactaagcaataagttccatctggctttttgacaggtagaattgatgtgttaaaaggggagtctgttgggcagagtaggtgactgacaaggaggtgagaaatgataggctttaggcctatgagagctgcttgggggatgggatactgcttctgtgataggaactgggtggggactttaagagtaacgtggacaggggtgtggtgttttgtgattgagggtgtggaagtatcccaaacagtggggttaactatggatgggggataaggaaaggttgcatgttttaaggtgggaggttggaggagtagaagaaagttagaagccccagaggggtctgggttgatgcgttgggtactatggggaatgtggaagtggagagtagtgtggagttttgaaaggatgtctctacttaggagcagagttgggcatgagggcaggactaagaaagagtgagtgaaggaaaaggtgtgcagggagcagaaaagtggagaggtggctcggggtttggagacttgtccatcaattcccacaacagagacttgggaggactgggtgggtcctgaaaaattaggtaaagcagagtaggttgccctggtattaattaaaaaacatactggcctacctgccaccatcagggttacccttggatcacatgaagagatggtagttgccggggtgtctgttccagggcactgtcagtcttcagcagcaaggctgatgagatacgagtaggaggttttgactggctcaggaagggatgggggcagtccttgtgggggctgctcacagtctgacttccagttgggtcctccacagagggggcacagcctggtgggcttacctgggtttgggcattgtctggaccagtggccttcattgccacacttgaaacaggcaccaggtggaggtggattgctaggaggcttctgtgtggagctgcggcccccgtgggcccacagagcccctgatggcagaggcaagcatttgaaactctgcctgttttttgccttttacttttctcatcacgattgttaaggactttgaaggctaaattaagaaggtctcgtgtggtttgaaggctgtcgtcaagcttctgaagcttgcgccaaatactgggggtggattgggagatgaactgaaggtttaagatagtggttccttctgggctgtctgggtctaggttggtatactttctcatggcttcagttaaacgagacagaaaagggctgggtttttgtcgggaccttgggtgatttctgaaagcttttcatggttgactgctttatgagcaccctttttgagtcctgtaaggagacacacaatcatgtggtcttgatggcggcgtccaggggccctgtcttgataatcccagtggggggcctggttggggactgcctctgtgtcactaggctgggcaggagcttggtgatgaattgtatcagcatgcgcctgagctagggtccagatacggtcccagtcttctggggtgagggtggaagagaggataacatagaggtcatgccaggttagttcataagactgggtgaggtactgaaactctctaatataagaggtaggatcttctggaaatgaaccgagtcttttgttaatttgagagagatcagtgagggggaagggaacatgaactctaacaatatctttagttcctgctacttcccaaagtgggcactctagcacaggcgctgaagtaagcgtggggcatgggccaaagatggcacctgagcgagtatgggaaggagagaaggaagagcctggaagtggttcctgctgagggtttgaatggggaaaggggggttgagttaacaggcagtggaagataggggcgtaaggtggcgggatgaatttgcaagcctcaggagagggcgctgggggaggacaatgggtacaggcaattctagaattgtcctgaggaggggacggtgtagaaaaagaagtgaatacagctgactgggaagatggcagctgggaagatggcggctgagaagctaaagaggaggcttgggggttaaagaagatggttgagaggggagaggtaggggctgggagaggtagacagcagactgctggatcaaacaaggaaaaagaggtggggtggggaggaggaaggcgatctgggtggtgagaatggaggagaatgatttgaacaggtgagcaagaattgcagaggtcaggttgtgatctgagtgcaaaaaggcctggacataaggaatttctccccatttctccagttgtcggcaataattgcttaaattagttaaaattataaagtcgaatgttccatttgtgggccatttggacctgttatgtaattcgtactgtggccagattgaattgcaaaaaaagacaaggcgcttagggcggatatcttgcatgaggcctaaggtctgcaggttttttatgaggcagtctagaggctgccttttggaatggaagactgggaatttcccataacggagggtaggctcgggagaacagggaaaaggagaccatcctggacggccggagggagatgataaaaggagcgatcgtcactgctgcctttttcaaggccttgttcatgttcccttccccctcactgatctctcccaaattaacaagacttggttcatttccagaagaccctacctcttatattagagagtttcagtgcctcacccagtcttatgaactaacctggcatgacctctatgttatcctctcttccaccctcaccccagaagactgggaccgtatctggaccctagctcaggcgcatgctgatacaattcatcaccaagctcctgcccagcctagtgacacagaggcagtccccaaccaggcttagaggcatccccctaagaccagatgatcagtgagtgcctggcacatgccagagccttcttggaccaacattggatctttggattggagaaaccaagagaggccacgtggatttttctctgttaacccggctcctgggaaatttatcagtagatgagatcagtgactggtgtgcatgcacagagaggtgactggaggctgaggagcttcctttgtccggttgctgtggactaccgtccagggtggaaggacacaagggacgcggaccggggccccttccagatttcggcaccagatgtaaggctcttgtatcagtttgaaccccgagagcgcgccaatgaacaccacaaggcggtgtggagcaacgcgctgttttaatgtgtgcctgggtgcagatgggctgagacctaaaatggcatcagcaccaaatgagaccgggcaggggttttatagtctcctgtaaacaggaagtgcctcagtctgatgtaactgctacagggtacccggacggcctctctctcagccttcagggggtacgtgtcttctgccggccgtctctcttcctgcttctgctgtcttgctgatgcacgctgctggcgcaagtgttcttgcgccttgggactgggcctgagaagggatgagttattcaccccctcaccctcttcccgcccagcttccaggcctcagggaaagtctttcaagaatgtgttggagaactgttccagtgagcacagggctagggtaggaggatgaatgttggttcctcagggcagggtacctttcacagctgtatgtggaaggaagtgagggaggcctccaaactgaggatgggggttggcaggtggacagaaggtactggttctaggaataagctacccactgaatgggagttcctagattggggttcttcctggctgccttggagttcttccatcatatctttgtaattgcttctttcctttgcatccagggaagcttttgcaaatggattgtgtttaattttcagctgtgagctcttcattctgataagctgtcacagttatttatgaactaggtctcggaaagcaatggctagtgatcatgtgttgtggacaccccactctcactatgtgaattcgaggctggtgcttattaaggagtttgacataatcaggccccctctgtgtagctagttgttgatcttgactttgctgagggagatggacaccttcatctagtagggccctgagttgggggaattgggctggatgggcacacacctgagcacctgcagctcaggcttgccctctggcacccattcctggttcccactcctggttttcttccagcgcttactgtgggcctccatgaagtccagcaagaaggagtacatggctcttaaagccaggccagacatgcttggcactggaaacaacttcctggcattcctggtggtgatcatgtcattggtgagctccttgaagcatagccacaacttgctctcctccaggcctatgtgccactttcactctacatggtcacccttctcaatgcctggcttgttgctcacgcttcatggctctcagcaggtggtccactcggtactgcaggctcttcgatgcacactcttaccagtgctgtgggagctcattctcctgcctgcctcccccgcacccccactttcttctaagccccaacttgctacttgagaaccatctttacctctccaagacctatgaaggtgcctgggtccctgtatagacttggaggagggtaaggacggagatctggtcaggaaaggcactggtggtaagggggaaggttatcatacttgaactcctgaaaggcatgactagggcagacctcttgctcttttgtttttgcatcccctgttttttggcaggtgtttcccaggtgtattagtccattttcacactgctgtaaagatactacctgtggctgggtgattcataaacaaaagaggtttaattgactcatagttctgcctggctagagaggcctcaggaaacttacaatcatggcagaaggtaaaagggaagcaaggacattcttcacatggtggcaggagagggagagagcacacaggggaaactgccacttttgaagtatcagatctcatgagaactccctcactatcaagagaacagcatgggaaaactgcccccacgatccagtcacctcccaccaggtacaatttgagatgagatttgggtgagaacacagagtcaaaccatatcaccaggatcacagaagtagtggaagtggataactagaaggaaaagggcaaaaatcccttgcttatctgggtgccatctttctcttggcccttgatgctttccagatgtgacatgcttacatatgtcttctctctcctgagctacacttctgcatctttggaggcctctcacttgggatgtctctgctttacccttctttgaatttatcctgagctcctgctcctggaggttgaccccacaacctgttattgagtcagcccttttaggccgggtcacacacgatgtctcaaggctgggttaccctttgcagtgtgcactcagatcctgggcaactcacatcgttatgcaaagggtagcctgctgcacaccctctgcactctacttttgcacactggttccaaccaactcttcagtgagaagcagaacccaagctctgtgttcataggcacccagattccagaggacatctgtcattttctctcatgaactgtccctggatgtagttcaatgacattcagcccatggagcctgcagtctctcccagcctcagtgagcagttttctgggagccctccaactctcccacccaccactgcacttaatgagtatgtaggaggtgttggggggtgaggtgacagagaagcactctagagaggagtgaaatactatagcccactcttactgggtctttccaaccgcctcttaagattagtaaggttgaatggggtacaaaggtgagagtctaggggcctttagttttccccttggaaagccttggaggggaattcattccatgtcctgttataattatctggagaggtcagctctacattcaattgaacctgtgagtggatttggcaactgtcttgagcttagccctggttgccataactcattaagtttctcacaagcatttactatgttaacagaacgctgggaatggggtgtgggggcgggcggagaagaagaagacattcacagttaacacctctgatgacatctctgatagcaaatagatactattacaagactctatccacccaagagctaaatcgttagtcacagatgcaaagtgctgtgtggtcttgagtaagcctctcagttttcccatctataaatctagagtagcagtgcagatttacttggcaaggtttttctgaggattaaagtaccctaaatcatgtaattaaaatgaacataaagtattttccaaatttgaagagccatggaaatgagaaaaataattactaagagacccagtgaggggctatgtttgaactgttggccattccttgggcagtagtaatttcctggcaggaactggcctgggagggcccttgacagatgttgcacagaactagtttaagaagggctgactggcatgtggtttttattttatctttgtaaagctacagtgtgaggcctgtgacagcaggaggaggccgtgaggtattcacttgacagcctgccattgtcaactctaatgggagagaaacttcagtggctagaagggcagcctcaggttgtaagcgattcatttttagttcagctgcaataactcctgctggtgatttaatcctgtgacttaggaactcttcgtgtgtgcttgagtgaatgaataaaagagagacagagtgagagagagagagagtgtgtgtgtgtgcacgtgtgcacacatgcacacacattcatgtgaacaatttctattcactcacttgtgattaccaatgggccacattctatttaggttttggaggcttggcatgaagcatgttttgctaggatgatttgttttttggacaaggaagctaacatggtaagtcatatgataatttagtttatgtcttcattgttgcagagtttggctgatagcaagggcagtcgagaatgatagtctcatatagaccttaatcccagctcctaaagtagaatggaattgtggaaatcaagttttctggtctaaaataaatgttttgtggcattcttataaaaggaacaggttgaaaagtccctgtggaatcttaattttgccactgcagattattgaagaccccaggtgagcaaatcaactgtgaggaggtgatttttatcagttggcattgaacagaccacagcatagctatcacctgcatggccttcctttgcctttgatgatcgtgtgtgtcagtgggatggaggattttttttgttttgttttgagacagagtctccctctctcgcccaggctggagtacagtggcatgatctcggctaactgcaacttccacctcccaggttcacgtgattctcctgcctcagcctcccgagtagctgagattacaggcgtgtaccacaatgcatggctaatttttctatttttagtagagaaggggttttgccatgttggccgggctggtctcgaactcctgacctcaggtgatccttggcctcctgaagtgctgggattacaggcatgagccactgcacctggctgggatggaggattttaaaaggagttgtattgcctttttgaaaaaaaaatctagaggcaccccccccccccgcttttataatgacccttttgactgaaactttatcttaaaaattccaggataagggataaattagccagttgaatgtgatttccatgtgctataaattttcatattctcccaaaattcctttctcaatgcgatggcatttgggagtggggccttttggaggtaattaggtcatgagggcagaactctgatgaatgtgattaaaggccttataaaagaggttccacagagatccctcatcccttctaccatgtgaggtcacagggagaaagcactgtctgtgaaccagaagatgggttttcactagacaccaaatctaccagagctttgatcttggactttccagcctctagaactgtgagaaatcatttctgttgtttataaaccattcagtttataatattttgttatagaagccctgttggactaagataccatgaatctagagatattttgcatattttattcaccgctgtatccctaggccctagatatgacctgacatttatttaaggtgctcaataaatatttgtttgatgaatgaatcaatcgaaaaagggctataacctcctattaggagtgatctctgggtattggctcatgcttgccttttgggatcatttgcatggatgtcataagtgctaaaatcttaagccacgagaaatatggagcttgtttccaccgcagtgattttctgtgaaatcactacccaaagatttttcacgctttccaaaaatattttttgaatgaacacatgtcatgggtggggaagttttcctcttattgggcagatatttattttcttatttcatgcagatgcccctgtgatgttaacttaaccctactactgggttttccatttttttgcatttgaatcatactcaaacccatgccagagaacaatgcagttcagctttctgatgaccatgtacagtttttgcaaggtggtctatcttgtccctttttaaactgaggactaatttagtataaaagatcatttagagaacctattccatctattctagctttgccagcatgcacagaaacacccaatgccacaaaatcactgaaatgagactcacacaccaggattaagggaagatgatgcttttgatgaaacattagtgaacaaatagaattttagaatcaatgataatctctgcctcattatgtaatttaagccccttgatttgtacctgaggaaaccaaagccctgtggagcacagactaaggacgtataagaactggagttaagacttatgccctctgactgacagtaaattctttccatagtactgtcacagcatgccacagggaacaagtgtctttttatcttttaataactgtatcgaatgcttaaggccagaaagaagagtatagatgttaacagatatttgcactgtaccagctcccagccacctgaaagagcttgatgggtcggcatcagtgagtcttggagagtacatgaagacccgttgctcacagggtgtgaactgggagttggaggcagtctggtgcaggtggaaaggcattgaactggggtggagtgaggaagcttaggttctgattctgatcgagccattgccatgctatatatattttaccttgtttagtcctaattaccatcctactaggtagggatggttattcttattttaggaatgaggaaaccggggcttagaaaggttaggaaacttttttaaattaaggttatacaggctaataagtggcagagcttcatttgaaccccagcctatataatactacccaaaagttactgcccagtttccctctctgagcctcattgaaaagaaaatgtttggatgatctctgacattccttccaggtcacaaattctacatttgatcttgttttttttgttttttttagtgatgtttggctttgaagatttagtccaccccctttcctccctcgttgttggtgaactgattgttacacaaccaacctcacctcattgttggtgaactgattgttggtgaactgattgttatatatggtgaactgattgttatatagattttcacacgtctgtctcccaggatagtgtgctaagaggaccattggagactgtagaagtttgtttcttttaggtgtaagccttgtttctcagggtactatgctttcactagcatcttaaataattaggtgacagagactattaacactttattttcacataacaccaagtaactaagaattgctattattttgccaattagcccatgcaatccttagctcataaaccaaactattatcttcagatacatattagtctcgattacccagagaaacagaaccaattggagacctatatctatatctatacctgtatctttctataactatacatgtagaaagggagggagggagggagggaacgatggagaaagaaactataaggaattggctcatgtggttatggaggctgagaagtcctagaatctgcagttggcaagctggagactcaggagagctgatgttgtagttctagtgcaactctgaaggtctgagaaccagtagagctgatagtgtaagttctagtctgaggagaggactgaagacagaagactaatgttccagctcaaagacaatgaatgaattggatgaggctcacccacattggggtgggcaatctgctttactcattctgccaattcaaatgttaatcttatctagaaacactctcacagacatactcagaacaatgttaaaccaactatccggataccacattgcccagccaagttgacaaataagttaaccattacaatatactagaactattatgtttttacacttcaagaggtgttgaagtgactcagtcgatctaaggggaaaaggtgatatgctattaaaaatataaacacagataaaaactgtatgttttagttagggtaagctaactgttataacaaatagactccaaaatttctactggcttaatcataaaagaagtttatttcttgcttgttacaaagtactgatcaagttaccaggtcagcagagtccctgctaaaagaggcctcttcatctttaatatgtagcttctgaagtcagcccaaatgttgtcttcatctcaaccagctgggaggagaaaagagcatggagaagtgccacatgggaggattttatgagctaggccaggaatggcccaagtcttttctgtcacattcttttgcatggaactcagtcacatggctgcacctaactgtttgggggcggctgaaaaatgtagtccctggctgggcagcccatatcccagcatgtccactgtaccctgtataaagaatcagaagatctgaattctggaattggctttcctattaactggctggtgatcttttcttgtctgtaaaatgtaaaagcttgttgatatcccaaataccttcttgctctagaattctgtgtctctgttttgctctttaaaagaaaatgttctgtgtgaagacagctagttctttgcctggatgcagtgaaggtcctggttcatgcagcaaactttgtctcatgtaggacttaatactggcaaatcagggagccaagtctgggggctcttttgatcctgtactggataaattattattcactgggcatagtaagcattgattcatgggtggcagtttactgtattttaggggtcttctaagtggtgtgtgcccctggcccacatgaagatttttccaaagggttaggtgttacagccagcatttttagaggatcagttatctttaatttttatatgtacctactcctaaactgatcaaagaacatctgcaatgaaagaattttgttagttcttctttcccacctctttcacagttgcccttctctacctttacaaatgaaagtctactgcttactcagcctgcatcttgcatagttcattgttccaagtgtagaaacctctagggcaccaaagtgattttttaaaatatgtgtcacttatattcaagatattaaacatactttctccatctggcacattaaagagtatatttataataaaagttttgctttttatgtttagtaataatttatgaaaagtatatgtatttatgttgttttgatcaattatgtaccactcataattgagaatacagctcagtaaaacattatttaacttatagcctgatagtgacagaaacttaaaaaatattttttatttatatttggtacttttaaatttaaaactattttgccctaagagaaaattctatagcaaaggtgaaacagaaatacaatttcaagaagctaaaggagtgactgtgtgtactcgggtgatgattgagatagattccgcccttgtggctgataaactagtggaggaggcataaacaagtaaattagcaaaagtgcaagataattttagaccatgataaatgctatgaagaaggtaagcaggagggtggtcaaagaaagcctctcagaggaagtggcatttggtatgagcacagaagaagtcttctctcctcttgagcaaatacatcctctcaggttggggcatggatatggtggaagggaagcagagcttatttctgttaaaaagagcttgttcatggctgggtgcggtggctcacgcctgtaattccagcactttgggaggctgagacaggtggatcacgaggtcaggagatggagaccatcctggctaacacggtgaaaccctatctctactaaaaatacaaaaaatcagctgggcatggtggcacacgtctgtagtcccagctacttgggaggctgaggcaggagaatcgcttgaacctggaaggtgaaggttgctagtgccactctactccatcctgggcgacagagggagacttggtctcaaaaaaaaaaaaaaaagagagagagagagagcttgtttatgtatattttaaatggatgctgatggagatcaaattgctttggtatttatattcccactggatacatttaaaggaatgacataagtttgtgatatttaaactatttcaatagtcaccatacactagaaattatatcatttgcaaatatttaaacttacaatgaaaactttttcatatcaacctaaaatgaacaagtggtaaatagtttattaaaatgtttttggggatacatgagcaaaggactttcaaaaccactggcatagtagcttagaatatgggctttgagtttaggctgcttaagttggaatcctggatccactactactggtcgtgtgatgaagagtcagttctgtgagcaacagcatctgaatctgtaaaacagaactgtaatcccagcactttgggaggctgaggtgggtggatcacaaggtcaggagttcgagaccagcctgaccaacatggtgaaacccccgtctctactaaaaaaaaaactacccgggcatggtggcacattactgtaatcccagctacacaggaggctgaggcaggagaatcgcttgaacctgggaggtggaggttgcagtgagccgagatcttgccacttcactccagcctgggcaacagagtgagactctgtctaaaaaaaacaaaacaaaacaaaaaaacgaaaacgaacaaacacaaaaagcacctaagaaggaggaaatttgaagtttacatgagataatgcatgtcaagtgctaatctcacaataagggctgaacaatgttttctatattatcaacattataactttgctctcaactgtatagtgctgattgaactctattatctttcatatggttgcagagcaggctgaaaggtaaattgtgaaatctagccctttgctgaactggagtagcacttaggggcaaactacactattcatttcattctttcctacttgctttatgtgttattgattgatattcattcattcattgatagtccaagttgagtatgttttgagacacttactgagcagtcctgcaccttgactacagtgtggtctcttctcctccttgtagttcattgaagtcattccaaggaaattacagattttccttctctccctgtgcacgtgtacctctagagtgtagggagatgcaatcttgagaagagtacttggtttctccctgaggacaagctgatggcactggctctgtctcctgatgtccttgctgtggcttcctcctttgttctgctaaggccttagggcctttgtgtgacacagctggggattactaggaagaagtaaatatttgcaaagggtgttctgtagaatgttaaaaaaaaatagaaaaaaattaaaggccaggtgcagtggctcctgcctacaatcccagcactttgggaggccgaggcagatggatcacctgaggtcaggagtttgagaccagcctggccaacatgggtgaaaccccgtccctataaaaatacaaaaattagctgggcatggtggcgcatgcctgtaattccagctactcagggggctgaggcaggagaattgcttgaaccctggaggcagaggttgcagtgagccgggattgtgccactgcactccagcctaggcaacaaagtgagactccatctcaaaaaaaatgaaaaaaaaattgcaaaggaaaggggaccttgggagcaagttaacatggtctggtgaggtgaagagaaaagctgaatgaaggtggcattagaaggagagaggatttaaaattattgagggaagtatgattaaagaaactggaagatgaaggtaaaggatggtagaaaaattagcgttaaaaaaatagagtctgccaaaagcaaaagtaaggattcattaagatacatagcagaaggaaaattgtgaaatgaagtaaaggaaaaatacaactgatgaatcaccagggagttatagcaaggccttaaaaatcattaatggaaagtttaatgccaaaatattagagtaaaaagatagcttgaaagtacacagcttgtctgtgcctggctcctaaaaaacaccacagaacggccaatcctttgcctctggcacccacacagcatgcatgccctgaagtgaaatctttcataccgtccctatactccctcttcacacacaagctttgttaccattctttttatttcattcccactggtccaaaactgtatatgcaacctataagaactgacccagcggtgctgccaatgtgcaaagacctgcatccatgggctgcctacttctggcaaaggatcagtttgcttaagttgtccacttcccttgtcatactactgacttgtcaatattacaagtgtttattgacagtcttccttctttcagctgaaggcctttcaagttagggactgtggctcttttgcttattgtagtagtcctggaacctaatgtgtggagaatggattagatggggagagagtaggagtttacctactaccagggtaagaagtagttttggtgagttaagggtgacttggtttagggagttggaagctgcggcataggaaaatgtctgtttgagacttttaggagatatgttttgatgaaagaaaaggacttggtaattgattggatgtgggtactgagcaagggaaagtgtcaaggatgacttggagagagctctgattgggtggtggtataattgagtataacagagaacactggacgaggatcaagtttgcgagggaaataaaaaacccctgagatatcctggtggaaatgttgagttggcagttggatgtatggagctgaaagtgatgtcctttcactcccatttctctagacttgacttacttcctgatcccagatctctgtttccaaccaattattgaacatattatctggaaaaaccacaggctgctcattctcagcatgactaaaactcacctaatcatattcctctgtgtagcctggtttccttcttaaaatcttagtcattcagtgggaattttattttcctgtttcctctgtctctacctgacctgcaaatccattccacccttgtcatgtaagtctttttgatctatacgtctaactcttattttcatttccactgccattgttccactcccactgcctgatgctcattttacccctgcctattataatagcttccaaatttgtctccctgaaactgtgatttcttaacttcaagcacacgtccttattcacactgggtgcaatctttcaaaggctcaatagtaagtatgagttttaaccccacagtatgttagaaaacgcctttccccttctgtcctctgcatacctcaccaatcttgtcttctttgctcaaccaatctgtaatcagatctttggataacctgctattatacaaatgcgcactctaatttaggcacccttgtgcctgttgtttcctctcttcaggatgaagtttcttcacctttggccaccttggatactgttttcttagcttggaatgtgttttcctcacttcattcaaaggaccagcttaaacatcacctcctcatagagacctacactgtgcctgtgtcttggtttagctcccttgcctacttttactttaagacacttatcacaatgatgatggtattatttatgtgatcatttatgtaatgactatctctgtcactagattaaagacctcatagggtcagggtctgtgactatttcattcaccattgtgattcagcatctgtggattgcagttgcaagcatggatagggatgaaattagtcaaagagaaaatttggagtgaggaaagaaagtcaagacagaacactagggaataccaatatttatggagctggacatgaaggcagatcccacagagaagtctgtggaggagcactggagaaggtaagagaacagggcagaacagtgtcatggaagtcaatgatggagaggattccaagaagaaggagagaacacttaatagtctgggaccaaaaaaaaaaaaaaagataaatgaacttgaaggcatagcaatagaacctatccaaaatgaagcttacacacagagataaaaaagaccaagaaaaataagagagacctggaggcaataacatgttgactgacatatgtaaatgggaggcttcagaagagaagagagtaaaagagaacagagataatatttaaagaaataatgaccaaacatctttcatattttatgaaaggtataaactcacagagctaagaaactcggaacatgaagcaagatacctactagggaaaccacaccaagaacttcattatcaaattacagcaagttactaattctgacaaaaatcttaaaattagagaaaaaagggcacattccatacagggaacaacataaaaataattacaacagagttttcggaaactatgcatgtcagaagacaatggagtaacatctttaaaatgctggaacaaattttgtcaatctaaaattctagacccagagaaaacacctttcaaacatgaaacatgtctttccttagacaaagaaaagttgtgagagttggccagcacacctgcagtacaaggcttgttaaaggaagttcttcaggcagaaggaaaatgatacctgatgataatgtggatctacacaaaagaataaagagctctgaaagtgataaatatgtgggtaaactaatttcatcatttaaaaaattttaaaaaggcaacagtagactgcttaaaacaacaaacagcagcaacaatatattgggggaattcatgacatgagaaagtaaaatacatgacaacaatagcacaaagggcattgggggggaaatggaagcacaccaatgcaaaattcttgtattttatgtaaaatattgtaatgtttttccaaggtagacaaataagataaagatgcgtattaaaagccctagatgaatcattaaaaaataaagtatagccaataaaccaatagtattgagaaaatggaatttaaaaatactcagctagcaggaggcagagcaagatggctgaatagaagccttcaaccaattgtcctccttgcaggaacaccaaatttaacaactatctacccacataaaaaaacaccttcgtaaggactgaaaatcagttgagtgaccactgtacctggttttaacttcatgtcactgaaagaggcactgaagaggataggaaaaacagtcttgatttgtcagtgccatccctctctggttccctggcagtggccgcatagcaaagagaatctgtgctcttgcgggagggagagtacagtgactgtgggaccttgcattggaactcagtgctgctctgtcacagtggaaacaatactgggcagaactcagccagtgcacgtggaggaagcatttagaccagccctagccagcagggctttatccatcctagcagtgggaacttgagttctggcaagcctccccaccacaggctaaagtgctctggggttctaaataaacttgaaaggcaatctaggccataaggactgcaactcctaggcaatcctagtgctgggctcagagccagtggattttgagggcatgcaacctagagagacaccagctggaatggccaagagagtgcttatgccactccttccccaaacccacgcagtgcagctcacagctccaaaaaagactccttctttctgcttgaagaaaggagagggaagagtaaagaggactttgtcttgcaacttggataccagctcagtcacagtaggatagggcattaggcagagttatgaagcccctatcccaggccctagctcccagataacattactagacacaccctgggccagaagcaaactcattgccttgaagggaagagcccagtcctggcaagattcatcatttgctagcaaaagagctcttgaacccaaaataatcagcagtggtaggtgggtagtacatgccatgggtcttgggtgagactctgagatgtgctggcttcaggtgtgacacagcacattcccagctgtggtggctatgaggagagactgtttctgcttgagaaaagcagagggaagagtaaaggagacttcatcttgcagcttaggtaccagctcagccacagcagggtagagcactaagtgggctcttggggtccccagttccaagccctggctcttggacagcatttctggacgtcccctaggccagaggggagcccacttccctgacatatgagtcctaagcctggcaacattcaccacaagctgactggagatcccttgggccttaagtgaacatcagcagtagcctggcagtactcctcacaggcctgtagcagtggtcaccatgaagagagactcctctgcttgtggaagggggagggaggagtatgagggactttatattgtagtttgggtgtcagcacagcagcagtagaatagagcaccagggagattcctaagatttccaactctaggccctggctcctggatggtatctctggacctgcctggggcctggggggagcttgccatccttaagcgaaggacatgagcatggctgttttcaccacctgctaattatagaaccttagggccttgagtgaacacaggcagtaggcagatagtggttatagcaggctttgagcgaggcccagagctctgctggcttcaggtctaacctagcacagtcccagtggtagtggccacaggggtggttgtgtcatctctcccccagctctaggcaccacaacacacacacacacacacggagggaagaggaggaggaggagagagaaagaaacggactctgtttctttgggagaaagtaagggaagagaataagagtctctacctggtaatctggagaattcttccaaatcttatccaagatcatcaaggcggtacctctataagtctgcaagagccacagcgttactgagctcgaggtgtccccctaatgcagatacagctgcagtgaccaaaaactcagatgacaatatccaagttcctttgaatacctggtaagctttcccaggaaggatggtgtattagtctgttctcacactgctataaagaactgcccaagactcagtaatttataaaggaaagaggtttaattgacggttctgcatgtcttgggaggcctcaggaaacttacaatcatggcagaaggggaggcaaatgcatccttcacatgatggcaggaagaattgctgagccaaggctgaacttttaaaaacccaattatgtgtagtctataaaaatttatttaaataaaaatacacaaaagagaaaagctgggaaaagataaagctgttttagttatattaatagccaaaaaaaataagaactattaccagggataaagaggaatatttcacaatgatggagtcaatgaatcaataaggcataacattcctaaatgtgtattcaccttataactaaacctcaaaattcattaagcacttgacagatctggaaagataaaaagataaatctacaattataattgcaaatttcaccactccttttagtaattaatagaacaagtcaacaaatagaaatatggaagaattaaactaatcatcaacttgaactaattgacatttttaagaacatgtcacttaacaaatgcaaaatatacattcttttctagtgcagtggagcatttaccaagatagaccacatgcttagccattaaacaagtctccagaaatttaaaaggattgatatgatatagagtatgttttctgactacaagggaataaattagaaataagcaatagaaagatacatagaaaatctcaaaatacttggaaattaaatagcatacattgaagtaattaatggtttaaagatgaaataaaaaggaaagtagaaaatatttgggggtaaatgaaaagaagacacacatatcaaaatttgtgaaatgcagcctaaagggaaatttataggcttaaaagcttaattagaaaagaagaaaactctataagcaacaggccaagcttccatcataagctagaaatataagagcaaattaaaccccaaactagtaggaaacaaatagtaaagaagagaaataaatgaaatagagaaacagtgaagaacaatgaaatcaaaatctgattctttgaaagatcagtataatagataaactgctggctatattgatcaaaaaaacaaaaaggatgacaaatattaccaatatagataatgaaaaaggggacatctctaagattctttatatactaaatgtctataattaagggaatattataaaaaaacttgatgttaataaattaaacaaccttgatgaaatggacaaattccttgaaagacacaatcaaaactaactcaagaatcaacagaaaacctgaatatcaattaagcacattaatttgtaattagaaatctttccataaaaaaatgtataggcccagatttattacctggtcaattctattaccgggtcagtttattacctagtcaattctatcagacattcaaggtagaaatataagtgacaatcccttatccaaaacgcttgggaccagaaggactttagatttttgattttggaatgcttccattatacttaccagtggagcatcccaaatccaaaaatttgaagtctgaaatgctccaatgagcatgttctgtgagcaccatgttgttactcaaaaagttttagattttgaagcatttcctattgctgatttttggatttggaatgttcaacctataccactatatgaatttgttttgaaaatataggagaaatacttttattttatatggtcagcacttttctgatctcaaaaccagaccaaaaatattgcaaataaagacaactacagaataaaattacttatgaacatggaccaacaatcttcaacaaaagatgtgcaaactgaaaatgaaatatataaaaaacgtaatacatgataatcaaataatgtttatcctaggaatacaaggttgcttaacattacaaaattaatgaatgtagttcatcttattgtcataatgggacaaaaaccatatcatcatttcaataaatgcagaaaagccacttgataaaattaacatccattacatattatcatattgtaccataatcatcttccagtaaactaagaatagaaaggaacctcctcaatctcataaaaggctgatgatgacacatttctatgaatatactaaaaactaccaaattttacactttaagtgtttgaattttatggtatgtgaattattaaactgttttttttaaaaaacctgttgctgacttagtatttaacctgagtgcttttgccctaagatcaagtagacaaggatggtcactctctccacttttcaacattctattgaagactcttgccagtgcagtaagacgaggaagaaaaataagaggcacataggttagagagctacaagtaaaactgtctttattcacagatgacatgatcaagcatgcagcaaacagcaaatcttcatgaatctaccaaaaactagtagaactaataagtgattttagtaagatttcaggatgcaaaattaattgcatttctatatattagcaataaacagatggaaattttaaaaaggacaatattatttgcaatagcatctcaaagcatgaaatacgtgagtatgatgattaattttgtgtattagcttgactgggctatagggggcccaggtgtttggttaaacattacttttgggtatgtctatgaaagtatttctagatgagattaacatttgaatgggtagactgagtaaaacaggttgccttccccagtgtatatgggcctcatctaatccaattcattgggagcctgaatagaacaaaaagcagggaaagggagaatttcctctctctgtttttaagctgggacattggtctcctgcagtcagactggaacttataccattggctcctaggtctttggacttgaactggaacgtatatcatcagttctactgattctcaagcctttggacttggagtagaatttacattgttggttcttctggttcttaggtgtaaggacttgaactggaagttcaccatcagctctcctgtgtttccagcttgcagatggcagatggtctgacttctcagcctccataattacattagccaattccatacatatatagccaatttatatacatatatagttggttctgctcctctggagaaccctgaccactccaaaggggttaaattaaataaagtatatgttaaaacccctaccctgaaaactggaaacatttctatgtgaaatttaagaatatgtaaatgtattgatttatgatgtttatagattggaagacctgaaattgtgatttcagttcctcgaattgatttatagatttgatgacattccaataaaaatccagattttcttatagaaatgttcaagccatttctaaaacctaaatgcttagaataaccaaaacaattttgagaaagaacaaagttagaacacttaaacttactggctttaacacttactgtaaagatacagcaatcaagttggtgtgttattggcatagttttgacacatagatcaattaaacacaatcgagaacccagaaatagacgagcatgtgtatggccaattgatttctgacaaagatgccaaggtaattcaatatggaaaggaataccttttcaacaaatggtcttgaacaacttgttatccacatttaaataaattaacatcaacccttactttatggtacacaactggataatcttaaatgtaaatgctaaaactatacaacttctggaagaaactttataaccttcacgtaggcaaagatttcttaaacaggacacaaaatagcataaacataaaaagtataaaaaatttataaattgggctacatcaaaatttaaaacccgtttataagaaaatgcaaatgcaaaggtagacctcagacagataaaatatatatgtgtgtgtgtgtgtgtgtgtgtatactattttatattataaggactgatatctagaatatataaagaagtctttcaactcactgatagaaccaattataaagtcaataaaatggacacatttgaacaaactttaccaaagaagatacacagatagccaatatatccatgactagatgctcaatatcattcatcattagggaaatgaaaattacaaccacaatgtgatatcactacacatccgttagaacattagagtggctaaaattaaaaggaccccaaatactaactgttgatgaggatatgaaaccactgagattttcctgcatacaccgcttatgggaatataaaattgtacaaccactttggaaaacagttttggcagtttcttataaagttaaacatagatttaccataagattcagcaattctactcttaggtgtttatccaagagaaatgaaagcatgtgtccacaaaaagagttgtacacaagtgttctttcactttatttaaagtaacccaaactggaaacaacacaaatgtccatcagcaggtgaatgtataaataaaatgtttaacaatggaatactacttagtactgaaaaggacaaactatttaaacatgtaccaacatagatgaatctcaaaataaatgtggtaagtgaaagaagaccgaaaaaaaagtaggtattgtatgatattcaatataaacctctagaaaagaaaaacttaacatatatttacagaaagcaggttcatggttgcccggggccagtgatagggtgagatcggctgggaaggggcttaagagaatgatcttttgaagtaatggaaatgttctaatcttgactttagcagtggtaacatgggtgtatactatttgtcaaaagtcatagaatatacccttaacatgagatatgtaaactatccctcattaaaattgtgcttgtatgtagtagttgctgtttttgaggggcaacatcttggagtcagtaaagggaaacattataaaggtgttgacaatttctccatagtataaagcctgttccatattgggcactgtgtcaggcattcctgtgactcttggctgtaatacaaagcaacttcccacttaaatactggctaagaccaagagccagggttccctcctagaagtcccaagctggacccagaggaaggtgctaacatggtgtgtttcggccacaggtctctttcagaggaccacaaaactcactacctcccctctctgagataatggagtgagtgtgttaggttggctcagtggctcagactaaagcgtcagggactcttatatttaaaattgatgtcactgctaatgtactgcttgaatgtatctaagcccctgcctttctatttcaatttcctctgtggttacaggaaaccaactatgacagtccattatacatggaaggctagtgttgccagattttaatttggagagtacagaacataattttgactaattggtccagtaggaactagagtagaatctaaacaactctggaggtctgtggcaatgaaacagggaaggagggagagatttaatcaaccttcacccaggcaggctgttgacagatttctaggctgacttaatcaatgtacttatttctcaggtaagacctcaaaactatttggatctaatttcactatacttcatcctgttcatgatattatgctttcaaagtaacaagcctcgaattccttttaagggcacacaaaagagtaaaacacactttctttttgtcccgtctgaagtggacaaatggagtgggtgcatagaagttgtaactctgagtccacttaagttttgcaagtgtataagtcatttttcagtacacaatgaagttaacaattaatatctttgtggtatccagaaacaatgtcaaccaaaattggagcaatgaacctgagaattgaattcacttgagctataaatcataaacccatcaatctctagagcagaagcaaaagtgaagtcattgaatattataatagattccatatgttgttttaaagaaggcttaaaaataactagacttacaggttaccatatttctgtggcaaaaatttacatatgtgaataagaagtgaaataactgactgtccaatttttgcttctgttttctgccacttctttttagtagtggaataattatttagctcttgaagggcagggcagaggaagtgtgataggcactagagaatgtggaggagctgataaaatagaatatgaagggaggtagaagaaactgactctcagctttggtagaaaaggtagcacagataaggaagcacaatttcagataaccctcttggcctttcccctgctaccttattacagagagttagtgtttctccttaagcattaaagttacaaagccaaatagtaacatggccacaattctgtgaaaattttgaaaggccatgacaaaatgaaaatgaaagctttgttctaagtcagacagatctgttttcaaatttggaccctgctctgtgaccttgggcaattcacttaatttctctgagcttcagtttcatctggatggggaattaatacttacctcaaagagctctcagtgtaatacacttgtgtatttctctcttctaacacctatcctgtcagtttgaaatataatctatcattttgaaatgtatctctttcttctcatacgattgtagacttcccaggaattgagattaagaactcccagctcaagggccaattagtggagaacacaggcttaacttatctttgtttcgccctgccccatacacacctcgcacaataattaggctatagctacgtaaaactttagggacttcttccttcctgtgacagcatggtgctaggtgagatttaaggaaactacacgtcatgtccctgcaaatttgccatcttgttatagtcagtcagattggcccactaaccctccagctagaaagtcaggaatgctaaatcttatatttgcatgattgctgttgtgctaaggtgtcagaacgcaagatacaatcttagttcaagtttacactttggtttatgggaaatagcaaggtcaatctgtggcaatgaaaaaaatggaaagtcctgtaaaagtttaaggagggaagaataaaaggaagagaaaagaaactgtaacccagttggaatgaaatggtaacatggaatgaaatgatcctctttccccccagacagatgttggcatggatttcatatggactctgaaactaaagccgacacccaaccgagtgctcaagccctacattccatccacccctcatttgttagtatcaaaattgaggcatttcacaaacttggctatcgaatactgtatgtgtgtggaaaagggccagataaaatgggccaattagaacacagccacatctgtcaaaactctaacccttaaccttagtgaaaatataatctaggatcaaacacagaagccccgcagatgtacacaagtcatttaatgcagcccttggaaagactgtgatgaacagctggtgctattgtgaaggcctgatgagaaagccaggcttggttttgctacgaatatttgcaattttaaagaaaaaaaataggttctaattgagtaaccattgaatgtatcccagtaaggtccttcccataggctgagttgaaaatactctgactccgttgctatgcaaagcagtttctaaacatgttttgaaaatccgtttgaaatttgagagtagaatttggttctcaaaggcttcatttaggcttaaaaccttttggttcactctaaaataatgcgagggtttcatccttaatggactatcgaggttaaattcaacagctgcttctcctctgatatatatttatgaatgcaggatgcattctatatggtacagtacaccctcacagagctctgagtaagaggaaaaaaacatggaaacaaatttttttttaatgttggagtgtccttacggggtttgctaaaggacaaatggggctctcattaaaaatagggattgtatcttcttgagtatacatggatcgtgaccaacacaacagtttttactgaatttactgataaaaatgtcactatgttatgtcaagctcaagtctttgggagggtttttcaggattctgtaagatatggctttgactttgtattcgcttttgggcaccaggtcatcagggaaaagtcacaagatctatgcaaaaggcagcgtcaggaagcagcatctctagtggtttccccttggtttcattgtccctgtgttcctgtgttcatctgggttattgagtctttgatcccacatgggaaaggtttgccatgttgagccagtagtagtataactcattctaactaaggcacatagcttctgccctctcccctgctggatgagtattggaccaattcctttgtccttagcaccacttacaaggatttatttccattccagaggatttattcccattcagagaaggaacaacatagttagataggaataaaaatgctactctgtgtataaagcttcttgcacctagctaatctagcaaactggtgttttggtcttcaacactaactagatcattattatgtgacactaattaaagggtcttctgtaatgggataaggtgttatctgatcaaatgaaggaggaatgatatttggcagtatatggtatatgtgaaaatcatggtgttcttgctacttagagactgtgagaagggataaggattggcttagagccagctcactctacatgctctcccagaagtgttttcttgaaagagtttttccccattgggaccttccattttcctctggcttagtaaagtgactgtaattaaatagattcaatttctgtttatggtgaagtaaaagattgagaacagattgctctttaacctgaaatgtggaagggctagtcgattcggaagctagttaaaatgattttgtgtattaactggtaaactcaacagattttttcccctgtgaatctaacatttctagatctttgcattcctcccgtgagaagtccacctctgaatcctttcgagagctcagattcctaggaactcagatttttgaacatctacatgatgttattttgtaagtggaacactgactattaaaggatagcagtggagtggagtggtgagggcacagctctgggtcaggataactggagagaaaccctaaggcttattccataatctctcttgatttgagcttctgaggataaactgaggcttgtaacatgctagcccagtatctggtgtagtaaatattgaatgcactgtggtggagagggttgtgttgtcaatgttgctgttgttattgttgagacctaaaggattgctatgatctaaatcagcttaatttccttcaacttgataaaaattagcctgtgactattgaactggatgatgctctcctaatggtttttgcattttgccttcattcagccagttaaagctggtgtttacagaattgtgaaacatttgagcctgggacagtcatgtgatttacagttttgtcttgtttcatgctttccagcaacataattactgaactttttatcgtaataaaaatataggcaataaaaaaggcagtcccctggaattccctctatctctcttagaatgctaaaggatatttttttgtgatctcagctctgttctgttaagtatcctctcccttccccacgtctgtctttgcagatttgtgaccagacggctgcactgaatggagactaggaagggagcccaactgttttccttgtgttggccctctgtgccgagcagggattgttgagcaaagcagggattgctgagcagcgtttctccagggagggtcacagggtagtacaaacccactctggatttttcttttttttttaattattaaaaactttggccaaatactatcagtaagggggagaaagtatgtggtttgaagaccagttggaccagtcttttaaaatatcaactggaataaagcaagaatgccttacacttctttaattttctacatttaacaggagacagttgctcccagagtcacttctaactccacagacagtattgtgcaaccttgctcagcatttggagacactatataattaaaattcctttgaaaatggttgcccaatgattgacatttattccaaaatacattatcatgttgaatgcttaattccttcttccagtacattttctttaataaaaaagtaaaaatctattttttaaaagggtgatggagttttgtaaaaaattgaagcagtgtaacaaacttatgtctaatcttgctcttaaagagctggcaggctagcaggggagaccagagtaagttatggaaagcaaaaaaagcaatactcaggatataactgagttgccttatatagatagacttgaaatgctgctgagattccaaagaggaagagataataggaatctgttgctctcttacctcctagtacattgactcatacctccacttcaaacacaagcaacatttagtattactacgaaattatctaatgggcttcctttctcagggcagtaggaatctgtctctctgctgtggctttctggagtccttcccttctgatgtctgtctgtgccccagtttccattttcatatggtcatctttgattctggatagctgcttctctctgtgttctcagaagaaatagactagtgagatcactgtcatgccccctccacaattaggaggctgtatcttgagaccttcttggatcccacaatttgtagatatcacaatagcaatcatggttagagaagtctaccaccaaaccaggagttagatgctaaggatgggtgagcatgtccaaatagcagctttaaaaagcctcagcacacttacaatagactacatgtcagagttttgggttatctctgaatagtcaaaaccccgatattatatacatgtatgtaaagaggctattttaatatcatactgtttgtttgacttttgagtagtgaatgcataatatgggaataagtacaatacgtgagtgaaacaccgaaatcacctttcactgttttgtttagtagtttggagccttcagttcttctggaaaaataattcaatgcacattagttttgctttctacatttgagggaggtgaatgctttacttttgtaactgtaagaggtctcagcagtcttgtagcctattcatattaaagataaggacactgaggccaagaaaggtgaaatggcttgcttaatggttacacagagaattaactgtagcttcatgattttaactcaggtcttgtgactagaatttcagtgcactttgcattaggcaattctgaacctttgagtaaaactaaaatgcaaagactgctcttgatagcattctaggtggaagagttgaagatagtaggatataaagataaacaaacctatcttatctggacaggacctcagctcattaggaagaggaatgaggaagagagaatgtaggaggaaagaaatggcagaaagacaaataatcatgggaagggactggaacagggtaaatgccagacattttcaagattagaagaaatctgagttgagtttgaaaaattgaaagatttcttcaggtagaagcaaaaggaaaataagcagaaatattatcacatataagggagtctgcagaggaagaagaaaagcatgaccctaatagataaagataagaagcaccaaatcatttcaataagtttctgaattttaaacactttcttttccttccaaaccatttaaagaggaggaggaggagaaaaaaataacgatttgtgagggatgtctcatatgctatttattataagaaggaaagtaaaattcaataaattacaaaatgatgtatcaaacaaagttcagcatggaggttaataaaataaatacagacttgagtggagttgtgtcctagcacttacttttaaagccatgtttcaaaaaaagggcatccatggaagtgatggataatttttatctgatagcaagaacagacactaataatggcaagttattgtgttcttagattgttattttaatacttaacgttttcaagattagcctctgagaagctgctcatttacttttggtgcataatgatcacttagggtatgaagccatcagctgcgccctttgttatgaccatggaaaatgttatgacctcctgtcaatgattattttggaaggaatagaagaaataagttatgattacatattatagatattataagcatagtgttagtaaatattttaaaaagaagactaggcacagtggctcatgcctgtaatcttagtactttgggagactgaggcaggaggatcacttgagcccaggtgagaccagcctgggcaacatagtgagattctatctctacaaaaaaaaaaaaaaaaatctttccatggctttctcatctgcagattgtttctcagtgtcaagcaagcacatctttcttccatcccacctgtcttccctgttttaattttatttctgtgcttcataaggttgaggcagtatgcaatcacaatccttttacaattacaaaaaaattcccaaacaattttcttttttaatttttgagaaaaattttgcttttatgctctctgatcagatttgcctttatatacatacaggttccttttttcaccccactcccaacttaaggctgattttaccatccagttgtttaaacaaaattctgttttgggtatcaggtgttttaaattaaaaattcttcaaaattgatttccaaaggagtccgtaaggcttacgatattttagaccaattcttaactagaacagaaaattttgccttttaggtttacagtgatttcatattatctgatgattctgttgaaggggcccattatttatggtatttgcctggaggttgtcttgtaagccttgactatgtgttttaagaaagaaggcaggctgagtgcggtggctcatgcctgtaatttcagcactttgggaggccgaggcaggcagatcacctgaggtcaggagttccagaccagcctggccaacatggcgaaaccccgtctctactaaaaaatacaaaaattagctggaggtggtggcagatgcctgtaatcccagctactcgggaggctgaggcatgagaatcgcttgaaccctggaggcagaggttgcagtaagctgagatcacgccactgcattccagcctgggcgacagagcaagactccgtctaaaaaaaaaaagaaagaaaaagaaagaagtcagcagttcaactataagatgcacagtatatcagaggtagtggaaagtctacatatgcctcctattttaattttaacaaaaaaatgactctgtcacatagacttctagctctttttagcggaataggtaggaaacctataatgcatgaattgtttaaagaaagtatcgaggctgggtgagatggctcatgcctgtaatcccagcactgtgggaggctgaggcaggtggataatttgaggccaagagttcaagaccagcctggccaacatggtaaaatctcgtctctgttaaaaatacaaaaattagctgggcgtggtggcaggcatctgtaatcccagttactcgggaagctgaggcaggagaattgcatgaacccgggaggcagaggttgcagtgagccaagactgcaccactgcactccagcctgggtgatagcacgagaccctgtctcaaaagaaaaaaagaaaagaataaagagagtatggaataaaatgctagatttgaagaggaaaaggacaggttggtagcaggactggctatataatttgtggggctcagtgcaaaatgaaaatagaagtccccttgttcaaaaattaagaagtttaaggtagcaacagcaaagcattaaaccaagcatgaggctcttctgagcatggggccctgtgtgacttcataggtcacacactcataaagctcaccctggtcagaagttgagatgtcagtaaaaaggaaaaggaatgatccattccctgtgatgttttcctacctctatgccatccttacctatgtactcatcaggtgtgaccatctctcaagggggcaccattgtgccagtgagctgaggcacagacactggctctagtctatggaggaaggagcatgagaaggaggttgcattctaccagcggcgggagagtaggatggagctgaaggctttctgaactgatctaggagagagagcatgaacttgggaactctgcaactttctagcagtgtagtaaagttatttaacctctctgaatcttattttttcattgccgtaaaatggtgatatctacctctcagggttactgtgtggattacagataatgtggaaaatgcctagcactgtggctggtatgcagtggaagctcaagatatattgtacatatggtcatttttgtaagtgcggagatacactgaggatgagtgaaaaagacttcaagtctcagatagggtggaggatctcagaatgcttgaagagccttgtaagaactggctgcctctcttgagtccctccttagttcctgagtgctttggaatcgtttaaaactcacaattgcatcttcttcccaaatagggtgaggagcaatctgtgggaagtcagtgcacagtagagttcagtcttccaacgctgaaaatttgccaactttcacccacactgtggagatgagaaagcagctgtgggcagacagtagagtaagctgtggggtctctggaacatgttacgcttacggatgttccattgttcccatgagattttgtactttgtctgttttatccaggtttgtttccataatatacgaaggagacagccaaaaccattttatgtagttttcctactttgttttgatttatttgttattatttacagtattatctccaataacaacaatggaatttcctttcctactaatctggcctgtttccattttgcctgtttattttaatttcctttttttggactgaaatctctacatgactctgatttgtttatttccttgcgtgtatgtgtcagcatcatttattagtgtgtccactcagaggaactttgttcattaattatgtaggttttgtttcctggttcctaatgggagggtattaagtgctctatgtttctaagtacttcacgatggttttggttatcagtttcttcatcactgctctctgcaagtagatgggcttactctccatggcttacagatggagcatgggaagccccagagcagagaagtaactcctctgcagatgatgattttcttaaatccgctgacccgtcacgcctgccactcgtatagatttcaatttccacttacttttatttgggtagtgggttaagtgagcataacacctgtgttttgcagacgtgattccttgaagacatttccatgaaaaccagcctgttgttaacgaatgagcaatatcgtcttgcattataagctgcttggggggtgtgtgatgaatgttagacttatcccttttttgtgaagaacttacagcccactaagtcaataaaaaagttaaaaggaagaggtaacctgacttttacatctgttacttgaatatataagatctgctgcctccttttcaatggattgtcatgatttactaaatgattgaattaatgattcataaaacatttatttagtacttactctgtgtgtgatactatctctagtctcaagatgcttataagactagaaggcgaaaatagaattgaaagcaaataaatataataaaatgttacaggtgacatgatagaagtttgtctagagtacatagaataacaaaggagggaggcctgtattctcttgggatggggattggagagaaggtgtcacaaacaaaggctataggcaccagatgtatctggggtccatagatactttcaaatggctgaaacagtggctgaggaggcagcagtgcatgcatgaggtgggagaagggaggtggagaaagccagacacaaagatccttggatgctgtgtgaaggaatttgggttttattctttaggaaaagttttaggtagatggaacatcagtaacagttttgctttttagaaaaattacaccaagaatagactcaaggagacttgaatggaggcaaggagactcttctgataatatggggctgagccaggcaagatatgatgagattctgagcaagccagtggtggatggaaagatgtcaaagaagtagaccttgtaaaattggtatcaatttttaaataatatcttacagtaactgttagcgaaaccaaggcccaagaaagtgcatagccagtgaatatcaaagggatcttcctctgccttcattgcagtttagaaacacaattattgtggcatttcagacactacgttgtaatacatcatattgttaatacttgtttacaatctttctgtcctgaggctctaagcttcttaaggttaacagccaaactactgaattatttgtgtatgcctagcatggagcctcatatacacaagtgcataatagatgtttgaagagtaaaactcttgacatcatagccagtgcttcttccacatggagcacttggcatgaaaatatgaaaacatcactcaggtttgcctgacagccacccatttccatcactccccctgagagcaccaaagccaagtgatgagcaggtataacaggcagatgatggcttgcactttgctttaaaatttgtatcagtttgccattatcagaatgcattcttacctcccaaagcctgcattaaaataccaataatgaatatttagaatataaaagtggccataaaagttgatgcctattatgatactgtctttaatggtctcactagtcagaagtcaagcatgataatttgcttcgatgtctcttttaatgttacccattgttttaacctggatcacactttattcttccacacagatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggaggtaagatgactctaaatgacacagttggtgaaatgttggatttgtttatacctgagaccataattcttcgtgtagccagcaccacaggccagcttggcaaatctttattcaggggctgtaggcacagccatgactggagaacaagtaagtcaggagcatgtcctttgcacattaatgactacacagtgattcaggccaaggaggctgcactgaaagccagcgcttaaaaaatgatgatctaaggctcatatgcatataatctgcactttagcctcaggtatcagcagtgtagctgtgggtatcccgctagctacattctttctcaaggctgcccttctgtgacttccctctctcaagcctattgttgttgaagtttcatttgacttatataaaatgctgatatttgtgtgcatatttgtggggggtgtgtgtgtgagagagagaaagagagagaggggacggggagagagagagagagagatgctattattctttcaatggaaattataaattaaagcttttatttttattatgcgtttgaggtaaaatacatattggcaagatattgaaaaccatttccatataggcatgaagaggtataaaaggaagattggaaaagagaatggagttattaaccagatcatggaaaggcctaatttccctgagcttgggttgtgaccatcttttcagctcagcaaataaaattaaagctagaggtttttatgtttttgttttttttggagacaggatcttgctcttctgtccaggctagagtgcagtggcacagtcatagcttactgctgcctggaactcctgggctcaagtgatcctcctgtctcaggctcccaagtaactaggactacaggtcacacaacaccacacctggataatttttaaattttttgtaaagatgagactctcgctatgttgcccaggctggtcttgaagtcctagcctcaagcaatcctcctgcctctgccttccaaagcactgggattacaggtgtgagtgactgtgcccagccccaaaagctagaggttttaatacatgggaaagagcatctcagagagaggtagcaaagcaacaactaagatagcatagaaacgtaatagggaaaacagagaacactttgtcaatggtattttggctaccagaaagaccagcagctgttttctgagaggcttacctgggtgatattcattatcttgggtagttgtctagggtctggtccttagcttacatgcttggaaattttattttctcatgtatccaacagaactttctggggcaaactcacatgaattaagtttatgcaactaatatataaaaagaaaatggcaattccttaattgataaagacaaatagaagagttttatcttctggaatactcaatttaaaatgtttagcacacattctccttgtaggcaaacctaatgggaaatcaaataatgctgagaaagttgattcctaaggatggaatcataacaagtggaaatatataaattccttgtttgacagcatgaggctaagtatattggtatggctctttggttccaagtaacagaaattgactaaattaaggagaatgagaaattgctggaggatgttgagaagcttacagaattggtgagaagtttggaggactaggcttggaaataagacaggaaccaagtcagtagaaactgctcagggtgccaatcctggcacaaattctaaactggtcccttcccctccatattctcatattctgctcaggatgcaaagctgtgggagagaggagctcattgccaagtttagttgcatgcctttcttttggttattctgtgaagagaaagaggaatcttccatgggaaattattataccaactcctcactacagttgtgtttaaaattcaaattcctaatattgacacattatgacaattccaatccaaggaagtaacctaacaactagttttgaacatgtaaaatccagcagaagcaaatacaagccttctctatagggatatacttgcacaacagacttttttttttttttaaagaaataaactccacaggtggtagatgaagtctttgtgtatcttacctaacaggtccaagataagatgagatgagtgttgtgctgagggcacaaaatttaaggaagcactcactcttaggtttatgccctgtacttgcacaaaattgagagtgagtgtatccttaaattttgcaccctaggcttgatgcttgtctcactccagtcctggccctgtcataaatctgaatttggtgtttatcatttttatgcatatttcagtatttatactacatgcatgtggatctatatattcaatatacagtattgatttacatcttgtaaattttatataagccttgtactgtacatctacttctacagcttgtttttttgtttctatttttatgctgacatatgtagtttcactttattcatgtttaactgctgtttatattattttaatatagtcaaatttatttcttcattctcttgttgattaacttttagttttctttcaatacaattggcagtataatacatttttcctcgtgaacatatgctagagttttttctagcatagacacctggaagtggcatgctgagttgtaaagtatgaatacctttagttttgctagatattactagatcagctctgaaatgaggccatgagtttgtatctctgttagcagcatatgaaagttcaaccattctatatcctcacctgttattggtattgacagacctttaaatattggccagtctgtttgttttgaaatgggaccttgttgtaacacaaatttccctgaattcttgtggcattgagcatctgttcacatggatattggccatttagttttctgtgaattatctgttcttatcctttgcttgtttcttttcattgggtcatttgtctttccttgttgatttctggaaactaatgttttgtttactaaacaatcctttttattgatttcatgcactaaaacaatattttcccactcctaaatttttgttttaaattttaatttggtaaaatttatgtcttcttttctccttatggtttgtgttttttctgctttaagaaattatttctgacctcatgatgataaagatactctcctgtgtttcctaaaagttctaaaagttctaaatgtttgcttttatttgcttagtatttatttcacaatctgaaatagggatatgtgttttttccatatggataattaattatctagtgtcacttttgaatgttattgtttcttcttcagtttataatgctatttttcatgtatcatgtttctatagatatcctgtctgtggatatgatactcatttaactattctagctctaaaaaaaagccccgagtatccagtagggaatgtttctctgctgagctattgatcttcaagattatcttggttgtttttggaaactgcattttccatatggatttaggatgagcttgttcagttctgaagatatgaagaaaaattaagcagaaacttgttgggaatttgatttggatttcagtaaatttgttgactgatttggagagtatcaacatttttatattcaatggctatcttgtcttctttttgactttaaaggttatgctttaatatttcatccttaatgtctcaccaatatttgatcccacattcttttgctgtaggattttgataactaaggctaaagaagttccttcaattcatttttttttttttgctaagtgcttattttttaacattatagtatttgatacctacaaaataatacacatgcaagttatggattataatattgtggaatcacaaatacttgtgagtccacaaccaacttaagaaatagtttgttgagtctatatgtgaactgtttcacctactatctctttgatttctttccctgcaaaggtacccatcttcctgaaagttgtgtttaatcatccttttgctttttaaaaagtctttactgcatatgtgtatcctcaaacaatactgttgagttatacacacacacacatgcacacacatatatacacctacatatgtatgtatatataaacacatatatatttatatgtatggtgtctttggtgactcacttcttttactcaacattatgtttataaaatttttaagattcagccacaaaaatatatatagtagtacttcattaattttcactattgtacaatatgccattgtgtggttatatcatgattaattattcatcgttatgtggatgaacatttaagttatttatagttttttgccatgatgaacaatgctgatatgaacatagtatacatgtattttttttttttttttagttttcttatatatttttttaatatactttaagttctgggatacatgtacagaacatgcaggtttgttatacaggtatacatatgccatggtggttagctgcacccatcaacctgtcacctacattaggtagttctcctaatgttatctctccccttgccccccatcccccaacaggcctaggtgtgtgatgttcccctccctgtgtccatgtgttctcaagttctcattgttcaactcccacttatgagtgagaacatgcagtgtttggttttctgttcctgtgttagtttgctgagaatgatggtttccagcttcatccatgtccctgcaaaggacatgaactcatcttttttttatggctgcattgtattccatggtgtatatgtgccacattttctttttccagtctaccattgatgggcatttgggttggttccaagtctttgctattgtgaatagtgctgcaataaacatacatgtgcatgtgtctttatagtataatgatttatgatcctttgggtatataccaagtaatgggattgctgggtcaaatggtatttctggttctagatccttgaggaatcaccacgctgtcttccacaatggttgaactaatttacacttccaccaacagtgtaaaagcattcctgtttctccacatcctctccagaatctgttgtttcctgactttttattgatggccattctaactggtgtgagatggtatctcattgtatacaatgacccctgatgatgagcgttttttcatgttttttggccgcataaatgtcttcttttgagaagtatctgtttatgtcctttgctcaatttttgatggggttgtttgtttttccttgtaaatttatttaggttccttgtagattctggatattagacctttgtcagacggagagattgcaaaactttcctcccactttgtaggttgcctgttcactctgatgatagattcttttgctgtgcagaagctctacatttattgatttgcatatgttgaaccagtcttgcattccagggatgaagccaacttgattgtgatggataagctttttgatgtgttgctggattcggtttgccagtattttattgaggattttcacatcgatgttcatcagggatattggcctgaagttttctttttttgttgtgtctctgccaggtgttggtatcagggtaaggctggcctcataaaatgagttagggaggagtccctctttttctatgatttggaatagtttcagaaggaatggtgccagctcctctttgtacctctggtggaattaggttgtgaatccatctggatctgggctttttttgattggtaggttattaattactgcctcaatttcagaacttgttattggtctattcaaggagttgacttcttctgatttagtcttgagagggtgtatgtgtccaggaatttcttctagattttctagtttatttgtgtagaggtttttataatattctctgatggtagtttgtatttctgtgggatcagtggtgatatcccctttatcattttttattgtgtctatttgatccttttctcttttcgtctttattagtctggctagtggtctatctattttgctaatcttttcaaaaaaccagctcctggattcattgagtttttgtgtctctaactccttgagttctgctctgatcttagttatttcttgtcttctactagtcttctacgagcttttgaatttgtttgcttctctagttctttttttttttttttttttttttttttttgagacggagtctcgctctgttgccccagctggagtgcagtggcacgatctcggctcactgcaagctctgcctcctgggttcacaccattctcctgcctcagcctctggagtagctgggactacaggtgcccgccaccacgtccagctaattttttatatttttagtagagttgggggtctcactgtgttagccaggatggtctcgatctcctgacctcgtgatctgcctgcctcggcctgccaaagtgctgggattacaggcgtgagccaccttttatttgtaatgttagtatgttgattttagatctttcctgctttctcccgtgggcatttagtgctataaatttccctctaaacactgctttaaatgtgtcccagagattctgatacattgtatctttgttctcactggtttcaaaggacttatttatttctgcctttatttggttatttacccagtaatcattcagaagcaagttgttcagtttccatgtagttgtgtggtttttagtgagtttcttaatcttgagttctaatttgattgcactgtggtctaagagaccatttgttatgatttcaattcttttacatttgctgaggaatgttttacttccaattatgtcgtcaattttagaataagtgctatgtggtactgagaagaatgtatattttgtttatttggggtggagagttctgcagatgtctattaggtccgcttggtccagagctgagttcaagtcctgaatatccttgttaattttctgtctcattgatctgtctaatactgacagtgggttgttaaatctcccactgttattttgtgggagtctaagtctcattgtaggtctctaagaacttgctttatgaatctgggtgctcctacattggttgcatatatatttaggatagccatctcttcttgttgcatcgatccctttaccattatgtaatgcccttctttgtgttttttgttctttgttggtttaaagtctgttttattagagactaggattgcaacccctatgtgtgtctttacatgtgagatgggtctcctgaatacagcacacctataggtcctgactctttatccaattttccagtctgtgtcttttaattggggcatttagtccatttacatttaaggttaatattgttatgtgtcaatttgatcctgtcgtcatgatgctagctggtaattttgcacgttagttgatgcggtttctccatagtgtcgttggtctttatattttggtatgtttttgcagtggctggtacaggtttttcctttccatatttactgcttccttcaggagctcttgtaagggaggcctggtggtgacaaaatccctcagcatttgcttgtctgtaaaggactgtatttctctttcactgatgagcttagtttggctggatatgaaattctgggttgaaaattcttttccttaaaaatgttgaatattggtccccactctcttctggattctagtgtttctacagagagatccactgtcagtctgatgggcttccctttgagggtaacctgacctttctctctggctgcccttaaatttttttcttcatttcaaccttggtgaatctgatgattatgtgtcttggggttgctcctcttgaggagcatcttagtggtgctctctgcatttcctgaatttgaatgttggcctgtcttgctaggttggggaaattctcctggataatatcctgaagtgtgttttccaacttggttccattctccccatcgctttcaggtacaccaatcaaacgtaggtttggtcttttcacatagttccatattctttggaggctttgttcattccttttcattcttttttctctaatcttgtcttcactctttatttcattaagttgatcttcaatctctaatatcctttcttctgctttattgattcagctattgatacttgtgtatgcttcatgaaattcttgtgctgtgtttttcagctctatcaggtcatttatgttcttctctaaattggttattctagttagcagttcctgtaacctttttgaaggttcttagcttccttgcattgggttagaacatgcccctttagctggaggaatttgttattacccaccttctgaagtctacttctgtcaattcattaaactcattctccatccagttttgttcccttgctggtgaggagttgtgatcttttggaggagaagaggcattctggtttttggaatttcagcatttttgggctggcttctccttatcttcttggatttatctacctttgatctttgatgctgatgacctttggatggggtttttgcgtgggcatcctatttgttgatgttgatgttatttctttctctttgttaattttccttctaacagtcaggtccctcttctgcaggtcttctggagtttgctggaggttcactctagactctgtttgtctgggtatcaccagtggaggctgcaaaatagcaaaagttgctgcctgctccttgctctggaagcttcgtcccagaggggcacctgccaggtgccagccagagctctcctgtatgaggtgtctgtcatcccctgctgggaggtgtctcccagttaggaggcatgggggacagggacccacttgaggaggcaggctgtcccttagtggagcttgagcattgtgctgggagatctgctgctctcttcagagctggcaggcaggaatgtttaagtctgccgaagctgcacccacagctgccccttcccccaggtgctctgtcccagggagatgggagttttttctatacacccctgactggggctgctgcctttctttcagagataccctgcccagagaggaggaatctggagaggcagtctggctacagcagctttcctgagttgcggtggtttccacccagtccgaacttcccaatggctttgtttacactgcgaggggaaaagtgcctattcaagcctcagtaatggtggatgcaagctcgagggtcccaggttgacttcagactgctgtgctggcagtgataatttcaagccagtggatcttagcttgctggggtctgtaggggtttgacctgctgagtgagaccacttggcttcctggcttcagcttgctttaaaggggagtgaatggttctgtctcgctggggttccaggcaccactagggtatgaaaaaaaactcctgcagctagctcagtgtctgcccaaatggctgcccagttttgtgcttgaaacccagggccctggtggtgtaggcacctaagggaatttcctggcctgtgggttgcaaaaactgtgggaaaagcttagtatctgggccagagagcaccatccctcatggcacagtccttcacagctttccttggctaggggagggagttccctgaccccttgcacttcccaggtgagctgacgccccaccctgcttatgcttgctctccatgggctgtattcactgcctgaccagtcccagtgagatgaactgggtacctcagttggaaatgcagaactcacccaccttctgcattggtcttgttgggagctgcagactggagctgttcctattcggccatcttgccagatccccacatactatacatatcttatttttgcccatatgtaagagtttttccaggttaatagctattagatgaattttgagttgatatgtgcaagttctcttcttcaagttattgccaaactgttttccaaaatggtggtaccaatttatgctctcatccacagtgcataagagtttcccctattccctatccttgtcaattcttggaattgtcagatttcttaattttttttttttgagatggagtctcactctgtcaccaggctggagtgcagtggcacaatttgggctcactgcaacttccgcctcctggtttcaagcgattctcctgcctcagcctcctgagtagctgggactacaggtgcacgccaccacgcccagctaatttttgtatttttagtacagacggggtctcaccatgttggccaggatggtctcgatctcttgaccttgtgatccgcccacctcggcctcccaaagtgctgggattacaggtgtgagccactgtgcccagcccagatttcttaattttttaaatctagatgatataaaatagaatctcattctttgctcatcaattctttatgcatctcagctcgagaacacttttttttttcctttgtacttattctgagggtctaacagtaacacatctctttctctctttctctctctctctctctctctctctctctctttcccctttcctctctttggccttaagatgtctttattttgtgtgcttctcagagtgatagtttagatgactatagaattatagttctttgagtacattggaaattttccattgtcctctgccttccattgcactggaaggggagctagcataaagtttaacttgtattattttgaatgtaacatcttttctctataactgtttagatcatctctacattttttgctgtcctgaagtttcattcttctgtttttccatgtgggtttccttttatttaacattttggggtacgagggcttctcaaatagatgaattgatgtctttcatccgtctggaaatatctccaatttttttcttttgaaattttacctcattctccttttgtaactctagcaagatttatgtttgcttctctcactctctgcttatgtcccttaacctctcttttagagttactatctttttcctctctgagttgcattcttattaatcttaggtctgccttccaattccgtaattctctcttcagctttaatctgtcctttaactcaatcattgatttttaaatttcacttattgtattatttacttctagaagttttgttttgttctttaaaaatcttctagtcattttttcaatgtcttgcttcctatttatatttttattttttcaagacatatttgtcaagaactgtgaaggctatgagattttaattttttaaaatccacagttttgtggatgttgaaagaagacatgagactcttggctaagagcaaaagactttattactcacagcaagagcagcagccagagtgtcaacatgtttgttttggttttctatgttccaattcctagaaatgggcctagatagatacctgcacaggaagggaacattgaccttgggaaacttgccattttatagtaggtaataaacaagctggcattttgtttaagggggaagtattagctcatctctcaagttttcttgctacaagcccaatcctgaaaaataatctgggtaaagatcagccagggccttgaatttttggcatatatagcaagacatgtaggaacaagagagatccatgaagtagtgttgcctaacaatattaaatatagtgattttgtattctgagtgtggtaattctaaaaactgtgggtctcagtgtactatctgttgtttcttttggctcttgaacatggtgttttgtttctttgtgagttttgtgatttttgacagtgggttcattttttttttttcttggaaagaaggaaattttctccagagagaatttgcatttgtttctgggagcactaccaacgggaaactacttgaaaataaattcttatcttgatgtttttcagaccacttaatgtgtctacaggctagaaatctacagatgggcgtgcttgtggtagtaaattctaaggagaaaatgactccccctctctacccctcctcagcatcatatataaagatagtcaactttccttgtattgtcacagaagatatagtattactagctcaccttgatgctgagggaatcacattttagggtctcagttttatgcagtggggatttcctgttagattctctcccataagctaaccttgggctttgtatattgttccctacttgctttaaggtaacaagtcctatgttggttagagtaacattaatgctgtaacaaatacagtataaaatttaagtagcttaacataataaaagtttatttctcaatcatataatagtccaatttaggtgtttctggtgggagtgccccttttctccatgtgataatttagggaccaaggctactttcttcttgaagctccaccatcctctgggacctgggaatcttttgtattcacctggcaattcacaaaaaaagaggttgaagaagacacacccaattcttaactctctttgaccagacatgcattgtattagtttaccttctatgactgagaattagtcctgttgttccatacagatgtgagggatgtgtgatggggagatgtaatctctggctgagctgctacttaccagtgatgactcaatactatggaaagtgaaatacaaattgaattttggtgggcagttaagtgtcacagaaaacaaagtttaaatttacctggtttggccaatgacgtctgaatggaagctgacttcaatgcctatctgtgggttctgctttcatttaccttttggcttttaagagttcttaattttttgccagcctgtcatgtattaaaaaagatattttagttttattttatcaagtttttgtttgtttgtttgtttgttttagttatttgtagtgggagagtgaactagggtatttagtccactgtactgctggaactgagtcctacacactcctgtgagttatttagaaatgtgatcttaaaagttgaaagtctatttttttaaacttaccttttgaaaattacttcacttggtcagaaagtggcatctagataatgttgaatttctattttttggccatatttagttaattttttggccatatttagttaagtacctgcttgcacatgaatattcgtaactgacatcttgcaatcatttaaaagttttatgtagtcacaaatcagtttgtcaagtatatttaaaatgaaaatattattttcattttcaatgtagtgattaactgtaactattctatgcctttaaaattcaaatatttaaaatttaaatgataaataatacctatatgtagtagaaaataatgaaatctttattaaagggttaagtatgacaaatatctttatataatttcagtacctttttaaaaaaaaagagcaaggaagcaatgggagaattggacatgttttgtggtgatgtgttcaattttttgattggtgattacatgggtgtacgtatttgtcaaaactcattcaactatacatttaaaatggacatattttattatatgtaaatgatacctcaacaaagttgatcttaaaaaacggacaatgggatgagggaatagaattaaataaataaatcagtcattgccatacagtgtgctgtaataagtgtccacaggtatttcgagagcttagagcatgtaatccagcatgagtatgggcactcataggtgtgcatgtcaaggaaaggaagcttctcactgagctgatagttgagttcattctttttttttttttttttgacacagagttttgctcttgttgcccaggctggagtgcaatggcgcaatctcggctcactgcaacctctgcctcccgggttcaagcgagtctcctgcctcagtctcctgagtagctgggattacaggtgcctgccaccatgcccagctagttttttgtatttttagtaaagacggggtttcaccatgttggccaggctggtcttgaactcctgccctcaggtgaaccacccgtctcggcctcccaaagtgctgggaataaaggtgtgagccactgcgcctggcctgagttcatttttttttttttctttgagatggagtcttgctctgtcgtccaggctggagtgcaactttgacctccctggttcgcttaaaggaaaggtagaaactagcctggcaaatggaatttttgaaggggaattggatcaaatatttctggatcagggaaaactgtaaaggggagtgttagagagaatgtcctaccatttagagcatctgtagcagaagaggaatggcaagagatgaagccaagaggaaacaaataatgaaagtcttcacgtctcttacttagaaacttaggaagtatcctgtgggcactgtgcagtcaatgaaaggtttttggcaggctagtgacatgttcagatttgtttttagaaatgctagtctgtcagacatgtttaggatggccgaaaatacttcaaaacctctctagcccagattgctgtctctcttctctgtccacactatgctagccagtgctcaagtagtgattatttggggttgttctttttttcatgatagtaattcttcctctccaactagactgtctgtccttcagaccaggcctcttagtcttcttctttttaaaaaatttatattcccatattgataggtcacccccttagtcttaattctacttcacttatgactcccaaagcactggtactactagacacaggttgaaataaatatttgatgattgactgatgaattattttcattatttaatggtaataccctgtttctctaaattgtaacatcaagcagaatgttgtcatctttgggtactaaggtgattcatttgactcaccattggataacacttagttgggtggtttgtttgtttttttttttttgtattgctgattgaatttgcacggagtcatccactatgcactggacttatctatgttcaatgttttacaagaataccacaacgatatgcaatgttctctatggctatcgaacagagatgttctctacgtgaaattaaactggcgaatgtctgtatggagactggacatatgacctcttctctatccagctcaggaatggggcttcacattgtaaaatcacattcttggaggaggaaatagtaagtgttcatcatgcatgctttggagattaaatcatacacatctgagagacaggaagagagaagtttttaaaaactggatggcaatttaggcaagcagtgggagtgtattgtattaaactgtgaaaagccagctatttgctgaattgtggtttgatgacagagctagggtccttctttatgattctgaatgaatttctatttcactctgccacaaattttcatatgaggcaaagggatagaaatttactttctaggaagttattaatatataaaaatgctttgatatatgaatctctgagatgggtaaaatagacatatcagtagtgagaaatggaatattgagactgaataatattctgttgggtttacaagaaaaagaaaatatcatttattgagcatctattctgtgtcaggaactgcacttggtgctttcatatttattaatatatttgtcacagccataggtacattttcattttactcataaggattatgaagattagaggttaaggcacatgctcaaatatacatagctgtttggtggcagagtaagattgaaattcatttgtctctcatttgtctttgttctataatctcctcatgaagcaaactaccaaaattgttaaatcactctaattttacatttagttttcttgtccagaccataaccattcctggccagggcatcaacttcagctcaataactggtaccaatcttgctctgttagaccttggctctgcaatgcccatgtgaacaaataccagtgtgcccattgagtcataatcttcttccattcctcaaagtgctggctcagttggtgtggctaggcttctatctcagttctcctatatatcatctgtcttagccagttggactgccacaatgaaatagcacagactgggtggcttataaacgatagaattttttttttttttttgagacggagtctcgctctgtcgcccaggctggagtgcagtggcacgatcttggttcactgcaagctctgcctcctgggttcacaccattctcctgcctcagcctccagagtagctgggactacgggcgcctgccaccatgcctggctaactttatatatattttagtagagacggggtttcaccgtgttagccaggatggtctcgatctcctgaccttgtgatccacccgccttggcctcccaaagtgctaggattacaggcatgagccaccgtgcccagccaacaatagaaatttctctctcacagctctggaggctgggagtctgacatcaggatgccagcatgtttgggttctggtgaggttccttctctgagttacagatggtgtcttctcaatgggtcctcatgtggcagaaaaagttggagagctctttggggtcccttttataagggcatgaatcccattcatgaagactctaccctcatgaccttattgcctccccaaagctctgcctcctaatatcatcacactgagggggttctgttttcaacctaacaaagtttgggaacacaaacattcagtccatagtaggacccagtttctcagagagactgtacctatttaaatggtgcccttaactccatcctatttaaatagaacttagaactctgttaggctccatgtagctctgtcttctgcataattgagctctgttccacttaccccaagctattaattggggtctaattgtaaacagtctgtttggaacctggctatttttacccaatccctgaactcctgttgctttcttggatatgaaagcttgccagaatcacatcagagttttcctatgcccttgttttgtgttccttctgagcttggttagtcacgtgcagccataagagatacaagagaggctcaggaaaaaacaaaggttattacacttgcaggtcctagagagaggagatattctgcatgggaagacacgattgtggtcatgaggcagaagacaagagtgagtgggaagcttagattacttctgtattggggtttttgaggaaaaggcatgccacggcagggagaatgtttgggattggttagtttgaacacttttggtgggttttctgctataggagtagtttctagttgcctagtacctggccctgggatgattaaggcagataaatactgtctcctgaagtatccaggccaaacagaggagataaggcttttgcttggttaatttgcacatcaaaggtatgctctctgacttttgttatctttaagaattagctagcccagggaaggcagtctctcccagttgtaaagtttttaaagacatcaaaacatcataatatacagaaaattaaaaaatatttacaatacagtccttgggacacatcttaccaaacagcctgctactaccatgggacacatacctctagtcagggaagtctctccagctccagtttgtcaactgtcttattcttttccattggcccttgttgccagtctcaagattccttgtgattaagaccacctgaatatgacatgatgcatttaataagtttcttagtctaaactaaaggtggatactgaggatattaaagctttcattatggttaaatttcactgttggtattagaatgtgctcaagtatcacctcttccaggaagacatccttgatttttctggtcagggttagtgaccctcctgtgtggtactgtaatatctctgcatatctatcttataagactcatcacattaatggtacacacatacctcgtggatacctggtttgtttccagaccacctcagtaaagcaaatattgcacaaagtaagtcacataaatttttttttgttttcccagtgcatataaaagtgatgtctacattatactgtaggctattaagtgtgcaagagcattatatctaaaaagtacatatcttaatttaaaaatactgtatttctaaaaaatgctaatgatcatttgagccttcagcaagtcataatctttttgctggcagagggtcttgcctcaatgttgatggctgctggctgatcagagtggttggctgctgaaggttgcagtggctgtgtttcttaaaataagacattaatgaagtttgtcatatccattgactcttcttttcttgaaagatttctctgtagcatgcaatgttgtttgatagcattttactcacagtagaacttctttcaaaaccaaagtcaggctgagcatggtggctcccaccagtcatcccagcgctgtgggaggctgaggtaggaggattgcttgaggccaggaatttgagactagcctgggccatatagcaagatccagtctctgcaaaaaaaaaaaaaaaaaaaaaaaaacaaacctgggtgtggtggtgtgtgcatgtagtcccagctactcaggaggctgaggtgagaggcttgcatgaacctcagcaatcctcactcaggaggctgtagtgaggtatgattgcaccactgcactccagcctgagcaagagagcaagaccctatctttaaaaaacaaacaaaaaatgaagtcagtgctcccaaaccctgctgctactttatcaactaagtttatgtaatatctaaatcctttgttgtcatttcaccacattcgcagcccattcctcaggagtagattccatctcatctcaagaaaccacagtctttgcttatctataagaagtcactcgttgtccattcaagcttactgtgagattgcagcaatttagcctatctttgggctccacttctaattctagttctcttgctatttccattgcactggcagttgcttcatccattgaagtcttgcacccctcaaagtcattcatgagggttgaaatcaacctcttttaaacttctgttaatgttgatattttgaccttctctcatgaattatgaatgttcttaatgacatctagaatggtgaatcctttccaaaagattttcaatttactttcctagatccatcagaggaatcattatctatggcagctatagccttatgaaatatatttcttaactaatcaaacttgaaagacaaaattactctctgacctatgaaatgatattgtgttatgaaatgctgtgaaatggatattgtgttagcaggcatgaaaacaacaatctccttgcacatctctggctcttgggtgaccagccacattgtcaatgagcagtaatattttgaaaggaatatctttttttctaagcagtagtctcaatagtgggcttaaaatattcagtaagctgtatatgctgtaaatagatgtgctatcatctaggctttattgctccatttatagagcacagccagaatagatgtagcataattcctaagggctctaggattttcagaatggtgagtatttgctttaacttaaagtaagcagctgcattagcccctagcaagagaatcaacctcttctttgaagctttgaagtcaggcattgacttttcctctctagctatgatagtccaaaacggcatcttcttccaatataagactattttgtctacattgaaaatctgttgtttagtgtagacaccttcatcaatgatcttaactagatcttctggataactttctcttgctgtagcttctgtatcagcatttactgcttcaccttgcacttttaagttatggagatgtcttcttctcttaaacatcatgaaccaaccgctgcaagcttcaaacttttcttctgtagcttcttcacctctcacagccttcatagaactgaagaaagttagggctttgctctggattaggccttgttaaagggaattttgtggctagtttgatcttctgccagaccactaaaactttctgcatatcagcattaaggctgttttgctttatcattcatctactcactggagtagcattttaaatttccttcaagaacttttcctttgcattaacagcttggctaaccatttggcacaagaggcttagcttttggcctgtctcagcttttgacatgccttcctcactaagtgtaatcatttctaggttttgatttaaagcaagagatgtgtaactcttcctttcatttgaacacttagaggccattgtagggttattaattggcctgatttcaatattgtcatgtctcagggaatagaaaggcatgaggagagggagagagacaagggaacagccagtcagtggagcagtgagaacacacacagctttgatcaatttttttccagcctacatcatgctttgaatacataatagtaatttaaaagtttgaaatattgcgagaaaattaccaaaatgtccagagacatgaagtgatcacatactgttgaaaaaatggcaagacctgcttgatgcggggttgccacaaaccttcaatttattatgcagccaacaaacatatgaaaagaagctcatcatcactggtcattagagaaatacaaatcaaaaccacaatgagatgccttctcacaccagttagaatgaccatcattaaaaagtcaagaaacaacagatgctggagagggtgtggagaaataggaatgcttttacactgttggtgggagtgtaaattagttcaaccattgtggaagacagtatggcaattcctcaaggatctagaaccagaaatgccatttgacccagaaatcccattactgggtataaacccaaaggatcataaatcattctactataaagatacatgcacatgtatgtttatcatggcactgttcacaatagcaaagacctgaaaccaatccaaatgcccatcaatgatagactggataaagaaaatgtgtcacacatataccatggaatactatgcagccataaaaaagatgagttcatgtcctttgcagggacatggatgaagctggaagccatcattctaagcaaactaacacaagaacagaaaaccagacaccacatattctcactcataagtgggagctgaacaatgagaacacagggacacagggaggggaacatcacacactgggacctgtcaggacatggggactaggggagaaatagcattaggagaaatacctaatgtagatgacgggttgatgggtgcagtaaaccactatggcacatgtatacctatataacaaacctgcacgttctgcacatgtaccccagaacttaaaatatatatatataaaaaaacacagtatctactaagtgctataaagtgaagcacaagaaaacaagctgcctatacttttatatttacatattgttgtctctcaaactaaaatgtaagctcctcaagggcagggcctctgtcataatccatctttatgtgcccaatattattcacagtatctggcacatagtgagaacctaacaagtacttattaaatagagaaaatgtgtagagggactaagaggttggtctccagagacagactggccatgatgtgcaaattccttaatctgtatttccgtttctttatctataaagtgggtacactaataggattgttatgagaattaattgagttataatatgtaaattgcttagaatatagcttggtacataataagcaatagatgtagacttttattgttattgagtgaatcagtggggaaagagtacaaaatgttacaccacatgggcccaccaattgtacaatagttgcttttgactcctgctgcctgaattcaagatttccctcacattctggaaagccccacactccaggatcctttgtttttaagtgcctgcagaatttgtactgggtgacacagttgtttggctccaatgagactaccctgctaatatttgtaaagggtgacctttcacaaaggaagacaattggcctgaactaaatagcattgtgttgagatacaaaaattatttgcaggggagaccagatatgggtgtattattaccacaacaccaggacttcagtccagggttctcctgctcaccacacagaaagccaatcactgagataatgagcattgccagggaagaagggtttgagtgcttcagccaaggagatgagagaccagtctcaaatctgtctcctcaactgcctaaaattaggggctcatgtggcagggaagaaatgtaaccatgtatgggaaaacaggaatcagggaggagtaaggaagaggaactgatcaataggaagtagatggtcagtgggcagttattatgggtgaggggtctggcatcccattgtccagatgtggtgatctggtaagtttcagttccttgatactatctgggagccctaatggtttcctgagaaaggaactcagataatacaaatataagtttttcaagttttaatactgagagggtcaatttctatatttattcaaaagaaaccataaacatcacttctatgggacaattgggctggttccagtcctgatctttctatttatcagttcctcaatcatggagaatatggttgtcgatctttcgggctgcttcatgctaaaaagggggcattgtgagcagctccataccatgggtaaccacgtggccacccaggaatcaaacgttaatttaataccatagttttcttctgtgatacaatctttatgtctccaatccactacttccaccaaagacaaatcatagcaggactaacctacctgaaaaataagcatcagtcccactatacttggcctgattacccatataaagtgcagcaagaatcattgtccatataggctcttctacattggctttgctggaacctctcacaaggaatcagattcaacctccaaaggcctctcaagcctagccaaggatccatctgtgtctacagatatttacatgaattgggtgaactcctctctttccaaggccccaaaagaacttgtggttcctgggcctgccaggaaggtgactctctacttaccacaggccaggaaccctgcaaaggaactgcatagacaaggtatgaggcatctttctaaggggttctcattggctctataaaatcaatgtgaattcctcaaagctgtgtgctcatatcccaaaacatgccattttagtccaagtcctagaaaataaccagtgcctccaattgtttccaaatataagagaaaacagattcttactgatcttgcaaacaaccacattgcaatgaattaagaacattcacaaagtttctgaattctggataaatctggcagagagggagaaatatgcctcatttctgtatactcaattgttaaaggctataaacagctcaaaagaaaaaaattctgaagactctgagaaacaaaacaaaaagaatcagtaatgtttcaaacaaaaaagagccatgaaaattatttcaatcctcctgtagttcaatccatgcaatcagctcttgttctgctttatattaggttagcagtctttatgaacacatcagcctttcaattagtgttctggaagttttctctctggtccaatggcacaatctccaaagttatcagaaacctgcaatcaggagtccttttcatgaactctcccaaggaagccctgggttgtagctgattataagctgctttttgagaagaatcaaagcaaaacaacaattgtggatgataaaaatcttaggatagctatagtcaaagacacaattgacaagaaagtttgattatttctgtggcatccaacaatttaacataaaaatcataatttttactaataacatattgagacatatcagaatttcaggaatctcatacaatcctagaacatgtctatataaatataacccaaagaaataatgctaaatgatgagttaatgggtgcagcacaccaacatggcacatgtatacatatgtaacaaacctgcacgttgtgcatatgtaccctaaaacttaaagtataataataataaaattaaaaaaaaaaaagaaagttaaacaccatcttggccaggtgtggtggctcacacctgtaatcccagcactttggtaggccgaggcgggcggatcatgaggtcaggagttcgagaccagcctggctaacatggttaccactagaatcttcaaaccagtacaacacttgtacatactttgttttcaagtacacacatgaaggcccaacaatgataaggtttgggatcaaaaatcactagaatgtctcactttttttttttactactacttaattcaagtgactgtcacttaatatgaataatggtaaacacagctaaagtaatttgagagaaactccagtcaatataattttctaaaggacaaggtcaatctttcctgaacattaaaactttgtacccatatcaagtttttcctcattttctaaaggaaaagatctgaaaccaactcaaattattgactaaattgaattaccttggaaataaacaccatttaaacatatccactcccatctacttttccaaataacaaaatattgtactatttctgttcagaacttataaaagtaagtcttttaattttgtccaagagctttataaactcttatagatcattaaaggaaagcataaccaatgctaatgatcctatagatcattagaggagagcaaaaccaatccaagtttaaaaggctggtgtgctctatcatttttttttttgaggcttgacaaaggtagcttaggaattttagatagatagagcaaatgatgaatgttggaaaaacatgggaaaccaaatggctatccatagaaccaaatgcaagcttttcattaggaactgaaaactcatggctgggtatagtggctcacccctgtaatcctagcactttggaaagccaaggtgggaggattgcttgagaccaggagtttgagaccagcctgggcaatataatgagaacttgtgtctactaaaaattaaaaaaaaaattagccagatgtggtagcatgcatttatagtcccagctactcgggaggctgcagtgggaagatagcttgagcccaggagtttgaagttgcagtgagctatgatcatggcattgccctccagtctattcagcctgggcagcagagcaagaccctgtctcaaaaaaaaaaaaaaaaaagaaactaaagaacatcaatgtatatataagtaatatgtatatataagtaaaacccaaaggagaacaaacagcaaataaatgaaaattaaaagcaaaaacagataaataggaagccccaaatttttctcttactcagataaccttggaggctacagtgttacccacagcctaaaatacaaaagcacgtgacggatattttgctcctgatatgcaaatgaatgttcttaagtccaccaacgcccctatacattttgtgcaattaagaaattcacttcagggatgtgaccagttaagtactttagtgctagtactatctatgcagaatagaaaatatagtgtgaaacaaatcagtgcaagcatttagtgaaatttggctccatgctaaatctggcttcgtgctcaacaatattaaaaaagaattgctggccgggtatggtggctcacacctgtaatcccagcactttgtgaggccgaggtgggcagatcacctgaggtcagaagttggagaccagcctggccaacatagtgaaaccccatctctactaaaaatacaaaaattagctgggtgtggtggtgtacacctggaatcccagctactcaggaggccaaggcaggagaatcgcttgaacccaggaggcagaagttgcagtgagctgagacagtgccactgcactgcagcctggatggcagagtgagactccgtctcaaagaaaaaaaaaattgcccaactgccatgtatttctttaaaatatttcttgttttactttatcaagactaagagctttaactatgagcaatgttaattagcccaatatctcaaattttctctcaggttttaaagaatattttactgtctaaacttccgtcttctctgtatgtgcatgaaggtagacacacagagaaacagaaaaaaaaaaaactacatatgacttacacagaacaacagaaggaccatgcatggactttctgttttgtcttaaattctctttatttttaaatagccagttattttattttaggacaaaaatttaccgttccaagattctttctcatacaaaattcttttttactttataaccttttttaaaaaaccgaaaatacatcttcatatccataactttcttcacatctctctcccctacttaccagttctattctaccttatttcataaataaccttttcaagcccataatttgaactaacctttagataactttttttttttttttttttttttggagacagggcctttgctctgttgtgcagtctgaagtgcagtggtgtgatcacagctcactgcagccttgacctcctggactcaagcaatcctcccaacttagcctcccgagtagctgggactacaggcatgtgccaccacacctggctaattaggaaaaaaaaaattgtagagatgaggtcttactatggtgcccaggctggtctcaaacccatgggttcaacttatcctcctgccttggcctcccaaagtgctgggattataggcatgagccagccagtaacttctgaattaaacaaaattattctttttctcagcaattttatatacggaattacatattacatattaactacaattcttattcttagtatccttaagttttagtgaaaacctaggaagcaagaatcctgaactgtcatataagatattagcattttatagataaggaccattccacaatttttggaaatatgtttccctgtatcataaccttttcttaattgggaattacctagacatctaatgaacatcaaaaatgattttaagattttaaattacatcatgccatttctatttcattcagttttttcatttttaacagttttacctagattacttatgagaactgagatattagacaaagctagttgtcatttccttgttaacaattttgtaacctgtgaatagcagtaaggtccttaaagttaactacatgggtattttcaccaatactcagaagactcagctatattcattaaaccaacaacattaaattagtcttatttggcaaaaattgcacaaagatcattttgttttggctgagtttatagctttataatcttctgtgccaaaccctgacacctcaaaatatctacagagacaaatacaaaacccagacaaaaatgtatgctgacaattccaaagtcacatctacttttatcttaccaataattttaaagctagattgcttattaaagatttacataagtcacatgaacttgaaacatgcttggatagatttaattatgagctttcttttatttataagccaatttggtagacacaacatataacataataaatgttacacaatacataaacatgtaaacatgatacacaaacataaagctccaatagcttttactttggaactctgtagccatgagatagtaatacaaactcaccagtttacaaacacgttcacgtggctacactttgtttaccctgataggtaatctaatgaaggctgagacccaaaattttgggtaaggtcgtttccatggcagtttgatttttaaaggccaaacctcctcatactccaaagaacactgaggtcaaacagcaccataaaacatcatgtattaaccaggcccgacccagcttagaacagcagcataaaagtctggatacatgaaattccatcccactttttctttaaacatcaaaatgaggcccatggaaaggccacacttctctagattgcaaagaatattggggcaaaatagtattacaaaagatcagtttataaaattctgatttcccatgactttattaacacacatatgtagacaatcatcaaaacaccatccaactgctgcagcaacaagccccaagcatgtccagactgaaacagtccaggtgcttttctctctcaattggttgggcttgtttaacctgcaaaaggaaactccttcagaattcccctaattgagaggagcagatcctgctgtctgttacccacgaaagacatcatctgtccagatgcagatgacaaatttcaaaggctgttcttcctaggtgatcaggaatgaagttggagccagcagtgatagtaccagagagacagagagagagagactgaaacccatctctggccaaaaaaggggttaggcagctgcctaggagggcttctgaaactcctggcccatgcattcccaataagggaaccaaaatctgttaccaaaacaccaggggttcagtctaggtcatgctgctcaccacacagaaagccaattactgaaatattgccagggaagaaggctttaattgggtgcttcgcttgaggggagaggagaccagtctcaaatccgtctcctcaactaaaattaggggtttatgtggcaaggaagaaatgtaaccatatgtgggaaaacaggaattagggagggaaaaggagtagttgggcaacaggaaataggaagtcaggcgatcatgacgggtgaggggtgtggcatctcattgtccagatgtgttgatctggtaagtttcagttccttgatactttctgggaggtcttatggttggtttcctgagaaaggaacccagatcagacaaactttttcaaattttaagcctggaagcttcaattctatgcttagtcaaaagaaaccataaagatcagttctatgagacaattgggctggtttcagtgttagaaccactcatctctactccctccctcccctgtggatgaggtggtaccatactgcagtaagcattgtgcttctcagaggaagtgttcctgaacccaagtggaaggctgggttataaaccttaccttatcctggctgctcagctgatggttatttgaatgggaaaaggcaaaacttctccaagaggataaaatgagataggacttatttctagagtgcttggtcctgtaaaaatctactggacatttgcagccaatttagccctctctgtttggctccgaggcctagaatgagtcctgctttcactataccagacatgaacatttctttacattttagtgtagagagctaaggaaactccagtggaatttagtaaacaaagaaaaaaaaaaaacaagaaaaaaaatgaccagttttttcagggcctggaaattattcattcttggggccttaggtctctaagaaaaagtttgcaaagcagttgttttagcctattgtttcccaaaatatgttcactgtctcctttttattcctttgaaaacttgggagtctcctttttattcctttgaaaactccgtatgtcaagagaagcttgacatcaggcaataaacaggtaggggatggggtaagaacttaaacgctgaaatgtttcccatgaaagggaatagaagcatcttctgttctttaaactcatccttccttttgatacgtgagtgctgggaagggaagagcgtggttcctttaaatgatatggaagcgggaagggaagtgttggatagcggaggacatggtccctggctagggctccacccccacggacctaggtgaggacaggcacttgtgccttcactcctaaatgttgcgtttcccaacaccaccctggcctgccatgcccccatcctgggcctataaaaacccgagaccctagcaaggcagagacagaagtggctggacgtggagcagagcagataggcggaggaagacacaagtggctggacggtgagaggacacggaggggaacacgccggcggaagagcattttgacagacacaggcactcaagcaggctattgaccagcaggtttaggcggagtttggccagggcagtcggaggagagcgcccgctgcccagcggcccaactccagggataaaccatctcccttctggctcccccatcggtggacagctgcttccactcaataaaactttgcacttattctccaagcccacgattcttccaaggcaggaacctgggatacagaaagccgtctgttcttgtgacaaggtggagggtctgattgagctggttaacacaagccgcctatagatggcaaactaagagagcaccttgtaacacacgcccactggggcttcaggaactgtaaactctgctgtggggtgcccaagtctgtatgctcccctagaggtttgagcagcaggacactgaagaagcgagccacacctccgtcacgtcctgggagggggacaagggaacctttcctatttcactttaagcgggcagaaatgagaaagaaatgacattttttaaatttttccttagctaacaaatgtagggtgtctgggaaagttagtagttcttcctacagtagtagaaattgaaaaaccttcactggaaactctactcccatgtcctggcatctgagaaagttacctgctttacttgatgggaaaccttggtctacaggaaagtttgctgatgaagaaaatttcagaaagggggagattttggggttggcaggctcctgtgtaggaaacagttaacattctttaaaaaaaatttcactctgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgtgccactgcagtccgcagtccggcctgggcgacagagcaagactccgtctcaaaaaaaaaaaaaaaaaaaaaaaaaaaaaaaaaatttcactctgatatctataatcccaatgcctttgtacattatattgttctctcacaacacctagctcttactcatccttcagactctggaaattttccctgatctctctgcagaccacattatgtgcccttatcatttttttccttcctccctcccttctttccttctttctctcctttattttttcctttctttctgcatttcctttatgtacacttatcacattatatggcagttatttgttttatattcttttctagtagactatgagcttctaacacaaggaactgcacctatcctgttcaatttataccactgcaatgttgagatgtttgttgaatgaatggattaattaatgaacaaataaaggaatggacatataaccatctttgcctgtttgtgtttcgccctgagatgagcatgtgagtgacaggatttctgggaattagtggtgttttctctgatgtaatagaagagcagacccaaggctcagaatggcacgttttattctgtgacttgtacttgccaacaataggaaccattataattttactggatttctgagaatcagcaacatatgtgtgtagtaaaaataatgacaacaaaagcaaatagcctgatgaaaagagtccttagcatgcaggagtcttcccactctgatttacccttgtggtcaggtcacgcttccaaactaactcattgttgcctcaaaacattcatcttaagtagtatggatacaatgcaagaacaaatctgaatttcttcaaagtaaaaatgttgatcaaggaataaaaaaatggcaaacaaagagacttgaaacattgtgatggaagaatcatactgtatcaaggtgggaggggaagttatttttaaggaataattgagggtggtagagacttgggaaagaaaaaaaaaaagccaggatttcacatgggagtgcagacaaattataatttactaagagaagttcaaactgctgacagtattgtcacaacaaaagtgagtgattgccatatgcacagaacttaccggaagaagtgtagcaagccccttgatacaaagtatgcatatgaggacaagtaatccttttggacagggaacatggtgtcttccattttctgaagggatgcagggaccacagggaagaaagtgcagaggcttcactgtcccagacctgaactacagaaccaagcaggtgctggccactaagcagacataagaatgtgaactgagaactgagaagacatataaataaatgtttcctaattttttgtttgttttgttatgaaagcaaaaagggcactgcagaaatgataagggacagatgatttttaaacatctagtctcgttataaaatcttgtcacaccacaatcacaatgactgtgggactgggagaaacttgtcatttgccatctttaactgaaagcgatccaatagtcccatagacagttcttatggataaacatagaaattaacccttctggtcttaaagcttgaaacttacatttgttatttcttttttccttttttttttttttttttttgagatggagtcttgctgtgtttcccaggctggagtgcactggcatgatctcggttcacacaacctctgcctcctgggtttaagtgattcttctgcttcagcctcccgagtagctgggagtacaggcgcatgccaccatgcccggctaatttttgtatctttagtagagacggggtgtcaccaaattggccaggctggtctcaaactcctgacctcgtaatccgcccgcctcaggctcccaaagtactgggattacagatgtgagccaccacgcctggcctacatttgttatttctgagttcctcaggagaggacctccagtcttctcagaaggtatcaaataactgaaactcaccagatcacagcatccagacaatgagacgtcaggcccttcattcattatgattgcttccttacccctcctgactttgttttctcatacattattacattttttccttgctatataaacccctaattttagtccctcaggtagatggatttaagactgatttcccatctcctcagctgcagcacccgattaaagccttcttccttggcaatactcactgtctcagtgattgactttctgtgctgtgagcaacagaatctagactgaacccctggtgtttcggtaacatattccatcttctaatgctatttcttctatatgccttaatggttacatgtttcttgtacagtagagaaacttctatggtgtatatcaccacttaacttcttattttttcagctaaattaaccagaatgcttgtgaatgcagtgcactgatttaattttctgcacacttatgagatagtagcacacagcccataggaagcacttaattgatgtttgttaaatgaatggatgagtaacttatgtgaaagcacattctctggctcaagtagttcaagttacttccaaatataggcagaatttgaggatataggcaatgaagagaaaagcccatggattttggatgtaaacaatttagtttgaacatgggtctgacatttactggctatattaccttgggcaagagttaattctctaagtctcagtcttttcatctataaaatgtgtataataatatccttatgggaagattgaatatacaatttatatgaaccatttagcacaatgattggcatatagcaaggacttgatattatttccgtttttcttcactttagttaactcaggattgtcaaaaccacttgagatttggctctttgaaaatagtcttgaatagactggaagtaatatggaaaattgttaacatatgttaattccaggtggtagtaatagtaccatgattatatatatttgtgcttttctatgtctttaacagttctaaaaattaaacacataaaaaacaaagcattaaataaaatgacagatattattaaataaaacatcaaaaataaattgattcctacctttataaatatagaatagggaattgagtcattcagttgagttacatttgttgagtaactactataaacaagactgatgtggagcttacagttcagtggggaatacagatttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagattttttttttaaaacatgtgatcagagcaattgaaaggaaatacaaggttgtaacagcacattatgcggcacattttacctggatttaggagattcggaaaagctaagaggaattaatgatgtgtaggagtaagtgatgtataaactggcaggcagagaatgaacaggagtgagggatggaggcggggagtgtcccatggacaagaaaaagcacatactagagactacagggaatggagaatgaagaatagttcaatatggatggagcatagggttcaagatagaaggtgggggacagacaaggcttgcgaagagggcaggggtctgatcatgaaaggccatgaagctttgtacctcctggggagagttcatccacaaaaacatgacccccatctgtcactgttagcgaggtctccattttttgtactaatgttgtggtgcttaggaagcaataattcagtgcttgaagtctgatggaatgctgtggtttctggggagcccagaatcatggtgctgctatttttaatggacagaaacttactgtatttcaagtgaataaaatgagcatagaggttttgtctcctacacattttcaacctaaggacttttatagatggatcgaagctgtcctgagccaaagtgtatcagttctgcctaccatcagcagaagatattagcagtggtttgtttaatttctttttggactttcagagaaacagacttgaagatagcctttgggaagctaacttgtaagtacataagctttgtaatacaaagttaactttatcttaattttcgtatactgctgacattttcttgcatcagatggattatgtttgtgtcccggatcttgaggttagccagagtttgtaaaactaataaataattttacaatctggaagatttttcttttaacaaaaccaatggcatgtgtccattatcctatggagctaggacaacttgagtttggtttggagaatctagaacacagttgctctggggcagggatgaaggaggattacattctaatgacagtcatttgcaatgtctcatcgtgttcaaacataggacgattacacaaggtttcataatggaaaataagcggtccagataattcagaatacacaaaccatttggtgaccttgcctgtgactcctcagggagggagctcataggaaaactgatgatctgagattgtgatttgcccaaagttgcagaataacattatactctaattcccaactgttgctctatggacttggtttttacaattatctaagattttcaaagactctaagctttgcaaactctaattacatgacaaagttcctggccattagcttttaattttagagtatactttttattgtcgtttgagttttatgtactttttattgtcatttgaattctgcatgatgatagtcttcctttccttcactccctaccctgatcttcctttctccccaaccctattgatactgagaaaattaacatctcatttggaagtgggatgtttgaagggatagattatctttacagtttgtttcatgtgtccaagaaaatttttaagctgcagctcggggtagcatttttctttcctccagctctgtatttttttcttatttaatgtgatcagtagttcaaagcaggatctatttatttttggctcactttccacctcactggttgtgacttttagatgtgtatgtggattttgttctcacaggaagatctaaggagaccctgttataagcatgggttaaccgccataaggcacagctggtgcaaatcagcatgatgcagcatagcttagggttattggcagcgcttgtgtttagaattatacagtaaagaagaaaaggggctctgtactataggataggaaagaaggaaaaatctagcgggggagaagggaggatatcaaacataaacaggagagggaagacataaaagagtaggggttttcctagtgacctcataaacaagtagtatggggaaaactgtatactatgtaaagttttactaaataaaatgatgtttatatataatcctttatggtttcagggatttgggacaccttattttatatgatatgtttctgtcctttatgggggtaaacagagaaactgtggggaggcttgatagcccatggagaactgggagggttctttaaagaagttggggagaatggaaaatctaggatgggaaaaagggtctggattctatattccaaattctctgtcctcagtctgatttgatgtatgtcatctatggttcagctacatgtctcaggttttggatcaaaatatacatggtcagcataagtctctctgagcagattgacatattttcccagatcattacaaaagagggctcatcctttagggaattgtctgcatctttcctgaggcctggattcagtgctcctttgaagacaaatgggccgtgataggtggagcagtttctgtaagagatggtcctgtgccaaccccctggcagaattgtacacctggcactggtacaactggtgctccgcttagacttttctctcagtctttcatggacacctattaggtggctgggaggaagaaagaaggggaaacttcctcctcccctggaggacagactgctatcagtaaggaagctgtgtagctgttcattagaagtggtgattcttatttggagcattgcaaaatttcaaaattttcccttccttccttccttccttccttccttccttccttccttccttccttccttccttccttccttccttccctccctcccaccttccttcctcttctttctttcttatagtcttgctttgtcgtccaggctggaatgcaatgtcacccaggctggatcttggctcactgcaacctctgcctcctgggttcaagaaattctcctgcctcagcctccttagtagctgggatttcaggcatgtgccacctcgcccagctaatttttgtatatttagtaaagatgaagtttcaccatgttggccaggctggtcttgaactcctgacctcaagtgatctacccacctcagcctcccaaagttgctgggattacaggcatgagccaccgtgcctggccaaaatttctttttattatcttgagatcaagacgtgctcaggtttcacgatgagtgtgtaagatgactctcgatgctaattctaggacagtgtgtgaggtagcccccacagttaattctgggtcaaggtgagtgtgtgagatagccccaaagtttgctctaggtctgggtttgtggattgtgttggaaactttaaaaaacaaggacttgtgtagaagtttgaggaaagatagtttgtaaatttgtatctttttttttttgaatgataggaaagcatcagtgttgagttctgcaagccaattgaaaacagaaggtattttatgcatagtgtgtgggtgaagaatgtatttgtgaaggaggaaatgggtcaattgaaataactatcaattcataaaagagaaaatcagtatctaattagcatgaagaatgctcagatcaaatagtgtctaaaatgttgattcagtttagttttatataaaatacttagtgagatataaaggatatagaatttgataaaactcaccttgattccagtttcctccctgggagaatacctgtgaatgggtgcaacattcttaatgtgctgggtgacttgattttttgcaaataattattttggtggaaatgtgggttcataatgtttctaatatgctttgcgtcatttttcaggagcatgataaatttgaactgttacatctattttactttggagcagtcctccttgtcgtcaagggcatccatttttgaaacagctgtttggattgagggatacaggatgtggccataaagtagatcaaagttaattggccctcagggtaaacaagctcatgaccttggcctcattagccctgtgctgtaactagctgaagtaacctgccctgggcaggaagtttgcttccctgaagaagcttcagcatttagaaattatccaataagtcttctcattttgccaacctgccctcttctgccccagcactgaatgcttggatggtgagtgagaagagggggagattcagtgctttatgggattaccatcaggtaggaaaaaaaatgttaaagtcatgcttattttataggatttgtatacaggcttgaggataggttttggccaatagaaagcctctacatgtgtcacaacaaaaggtgtatgataggtgatactttcagcgcggtggactcttttgagtctcagttttgccttacctcttcatactgtctggataaataatgaaatatgccacaatagccctgaccatgaaatggattaatgaagctgcagttcaagactgtacacaagagtaaaagacatttttcctttcccaggcccaagaaaacaaaggagtcatgctgttccgtggcaatggagccaccagcagctcctgaaggccagttctctgcagctggtttatattcctcacacttcagggcctattgctaagtaggtttgtcaacatttcctccaagcacctcttttctagcctttccattggccagagggatggggcagggataagagtgatccttccgactttatggatagctaggacattttggttcttcatactctcaggcatggactagttcctcttatcaaaatctcttttctgaagtaaaataagtagaaaaaaatcaaattcaattgaaaacccagatgaagcaattattactcttcttttttccacttccttctccttcctaacacacacagtaaacatttttttggagagatcaatttcttctatgtagactggaatacttcccccttaccttagctggctgaaagtattatggattgctctgctaagaactctctttttcttccctctttggccacatacccagttgctattgaaaacactaacttagaaacccattaaaatagttatggaatatttattaagttttttaatactgtggagtataagaaacctaaactaggccccggtttttctcccaaatgccactccactctgttaagctatttctccaccccatctgatccatttactgaaagttaaccactgttaaccatttctcgagattctttacagaagaaaaaaatcatgcatgtacctgaatgtatatatgtacccatctctacatatatgtgtgtgttttaacatataaggtatcatagtgtacatgtcattctatacctggcatttttcctttaatgatgtgtcttagaaatcttttcatgttggcacacacagatccatctcattctaactacacagtaatccattacatggatgtgccattttcatttaacagtctctatactgatggacatattgatgtatttttaaaaccacaacaaactgtgctctaaaaaggttatgcccatttgcactctcaagagtataaaaatccattttgaatagatagaaaaataatattttcccagactcatgtagctggtttctgattttattcctaaagtgttttctgtgttctagtttatgaacacctgatacataaataagtgatgttcctatctagctcttaagctaatcaatagaataaatcttctttcacaccttacaagttaatgttcaccctgtgcttggccagaaaaggatgtgggttctatgaggattgtccaccgatggcactctgtccccagatacctgccacaaagataccagggctccaattccagaaaacatagcccaggaaacaggactttactattccatctccacccagacacgtggtattttgagaggttattgccaactctgctgcctttacacagacccatcaaatttgtgaggcaagatagaatcttttttgctacttctaaaggaaactcagtgcgttcatcagggaaatggagctcattacatggacagggaagctgggaggaataaccacttaaaagcactttgaagcgtgttcaatcacagttaaatgcttcttcataaaacttgatttttgaggtctgtttggcatcatagaacttgcaactattgtgtcttcataactcatggcctgggatttggcactacatatttttatggctgaacaggaatagtataatacacatgagagctactcagatatctaatattacagaataatgcagaagacagaatagatattgtggtgggtggattataattattttatttttgttggtaatgtgctctaggtaccatgcagggatttggtgagattgctgtcatattttctaaagtatctggaattcctaagaggaaagctggaaaatgagtgcaaagtaatgatgcacagtctccttaactctcctagtgccatgggggtgtagacaatggcaaaatgagagggtagtcagacgtccatgtgtagatctcactgctttacagggaacaagaggctgagtattgtactggatgcaagaatcaactttgcccaccttaatcataaacagaaatatctagttctccggcctgaaccttttccactggtactgaatttctaaagataactgaatttctaaaagataaccgggggagggtagagctgcattcccaggatccttgagtttcctatcaatgaggaaagctgctgcttatttgtggacccagtgggtgccaaaaggaagaactgaagggatttctactgggttactgaatttattccagctccgttttggggaactctcaaaccttggggtgaggagtgggggttcccagatgaattcaacaagagagagagggagggggagatgggaagagataagttcaaatagacaggcaaagggaagaaaataaggaacacacacacatacatatatataatgatacttagattggcacaaaagtaactgtggttttgcattgaaagtatagcaaaaaccacaattacttttgcaccaatccaatattattacctaaggactcacagagatttccttaagtccatagggacaggagcccttgccctccatgcttcaggaatgatttgattaaggatactaaacaggcatgtgacaatgtgagcttgctcaataataatccttgatggactattactcattttgtgaaattgagccaagtctctctttcctgctccccctttctccttatttccctttcccccagctactttgctttgctaagtaatcagacatggatcttattcccaagatatttatattcttagggaaataagacatttaaaataaggaagaatgcaataaaatctataatggaaacccagctaatgagccacaggagttcagaggagggagatgtaaccagttggagtggggaggagattatggattgtcatatttttgaatttaatatttattgtgaatgcctaagttaaataggaatggaatgggaaaaagacttttccagggtgtggagttgtcaggaataaatcagggaggtctgcagtcttggggcatgaatagcatacaatgatgagattattctgagtggagtgaagggtacacaagcatattaaggaagaagtttcaatggtgtggtggggctctaatctgcagggccttgaatgttcattgtcatagctacagataattgttagaaatagcctggtttgctgcaaaagacagggcaaactgggagggaccagatctgccctcgaggattgatcaggaactgtgaggaagtctaggctggcagacaaggcattagaagagatgtgcagaagaatatggcgatagatgacaagcggtcacccagacaagttggtactgagaggtaggagacaagtctcaaggagggaaggtgcctgatactgggaaatacaggaacaggtggcacttagaagtgtaatcaagactgagggaataagaaagtctgtcagcagttagcaggctccagccgctatgctcaggttcatgggcagacttccaagctctgggaggaaacagcagaatggaaagcaagaagctgggccccagccccagagggaccaggcagatttccaagccaggagtcagacctggaacatgggcctgactagcagtaagaatggttcaatactccattccagagtgctgagccaaagtcttttaatgccttctgcttaaggttatgactgaccttcgacgctgggtttacaggtgggagcagagcggtccagctgtttggaggggaggatgcagatactggagaaacagtcagggttcactgctggctaaagagtctaggccttatttagtgggcaaaaggagaacaatggaaaaattaaaacagaggaatatcttaattggagctgtatttcaggaagatcaatttgatcctagtgtgtaaaaggaaccagagttaagtgagtcctcacctgtaacaaatttcggccattctccttcctaagcacttctccagtgtgttcacttctctgcaggcccccttctaatactgtggcataaactatatgagtaaaattcatacaattaataaactaataaaacattaatttcacgtgtttcttttcattcttttcatgtggcttctggaaaaagttaaaatttataagcggctcacattatttttcagtggggcagtgctgctctaatcctttctccatattgcggttagaactttttaaaatgcaagtcttctcatgtagctctactgcatgaaatctccccataatctccattgccccaggataaagtctaaattccttagcatggcccccaccctctttgtcatctggccttagcccatctcccattgcactaatccttcaggtgtatcaaactattttcggtccacccgtgaaattactttgtattctttggcatccatgcctttgctcctgccattccttcgcttgaactgaatatttctcccctttttcatgtgttaacttttgcctcctattaaggtctcagctgtaggcatacctgactccttgactgtggattaggtgcttctccttgatgctaagggccacatcctgtgcctgctctactatagcatttctcgcattatttttgaggtcctattatctttatcctctacctagactgcatgttctttgaaaataggaactctgtattgatctttatgtcatgtccagcacccagcacagtacctggagcataatagctgcttgcatgattgtatgaatgaatgaatggggcagatgtgctaggtgaaatgaacctgaaccagcatagtggcattgggaatgaaaaggataagacactcatcaagaacgtaatttgtgagtgctggcaaccatgtaaattgacctctaattactggttgggtatcctttattcaaaatgcttttggccaggtacagtggcttacacctgtaatcctaacactttgggaggataaggctagaggatctctggaggccaggagtttgagaccagcctgggcaacagagtgtgaccccatctctacagaaaacttagctggggatggtggtgtgtgcctgtagacacagctacttgggaggttaaggcaggaggatcgcttgagcccaggagtttgatgctgcagcgagctgtgattgcactactctactccagcctgggcaacagagccagaccctttcaatcaatcaatcaatcaatgaaacaaaatatggaaaatgcttttgtctaggcacagtggctcacacctgtaatcccagcactttgagaggccaaggcaggaggattacttgagcccagaagtttgagaccagcctgggcaacatagcaagatcccatctctaaaaaaatattttaaaaattaactgagcatcgggatgtatgcctgtaattctagttattcaggagactgaggtgggaaggtcttttgagtccaggaatttgaggatacagtgaactatgccactgaactccaacctgggtgacagactaaaatcctgtctctaaacaaacaaacaacacacaaaaaaactgcttgagaccagaaatgtttcagatttcagatttttaaaatattttggaatatttgcattataccagttgaacatccctaatcctaaaatctgaaatctaaaatgttccaatgagcattccctttgagtgtcacattggcactcaaaaagtttcagattttgtagcaatttgggtgccagaatagggatgctcaatctctactaatgagtatgaagaactaatgcaattcataaaatgccctaagtcctaaataatattaaaaatagcaatgatgtggacaaatgttctaaggaaaaaagaaacattctttttaaagtattctgatacttggagtcaaaagacaggtttaagactttggtccagcatttatgttgtctgtagtcttgatatttcagttttttaggtcataaaatggagacagtaatacctctacatttggggctcattgtgagtattaggggaatatatgtagaagcatcttgcaaattgaaaagtgacagaaaacactagttattgccaatacaaaaatatttatacctgcaagtaggtgataaacatgctgtagtgattaaattgtacataatcgggacctgctcaaataatgtaaatctcaaacaaaccatcctagcacagaggaacgtggacaatttacactttgtcacatgacattccatcaatacaactcatggaatgagctaatgagagagtgagcaagaggtggcttgattgggcgccctccttcccagtgcccggtctgtgatggcctcacatttgacctctaactgtggctcacactattcactctgcttgcattgctctcttcttcactcctgcattgcttcactaaaccccagccctaccaccttaaaactctactcacattttaagtctccttcaggatgccttaatggggtacgagttctttgtctgaaggctcacagcattcagtacttctaaagttgtcttttttcctctctcaagagagatcccaatatcgtcttctcttccatttcctggtcaaggatagcactaacacctaagtatttccaaggtgggaattgaaagaggcctttccatccagcctgtattcctgtccccagacatgtgccagacctgtgctaggatggctgaattaaatggaacaaatgataacattagcatttgaatttggaatttagggtcaggatggttccatagaagctgctatagtttggatgtttgtcccctccaaacttcatgttgaaatttgatccctagtgttggaggtgaggcttaacagggggtgtttgggtcatgggggcagatctcttgtgaatggcttagtgtcatccttgctgtagtgagtgagttcttgctttattagttcccacaagagctgattgttaaaaaaaacaaaaacaaaaaaaaaagagcctggcacctccccgctgtctctcttgcttcctctctcaccacgtgatctcttacagctccccttcaccttccactatgagtggaagtagcctgaagccctcagcagatgcagatgctggtggtgcatctgcagagccatgagtcaaataagccttttcttcataaattacccagtctcaggtattcctttatagcaacacaaaatggactaggaaagaagcccacactcacttgcttcccttttacctgcttactttgttcattcccttgtttgtctcctgtactagtcagggttcactacagatacagaaataataggaatatatttaattgggaattggcttacatgatcatggaggctgagaagtcacatatctgctgtctgcaaccagcagcgaaattcagtctaagggcctgtgaatcaggagagccaatgatgtaaatcccagtccaagcacattaaaagatgagatgagatgtcccagctcaagcagtgaggcagggaaaaatgggacaaattcctccctcctctcttctgttctattcagtctctcaatggattagatgatatccacttccattggggagagcaatctattttacagaatttactgattcaaatgctgacctaaatccagagacatacctagaaacaatgcttaatctggacactcattggctcagtcaagttgacacataaaattaaccatcacacctcccttactttagatccaggagcagtatgtatcatttagtactttatgcacagtacatgttctgttgaggtcactaaaatagttatttatttacctggcccttgacagaggattatttgaaggattatgggattacataaaataaaacaaaaacaagggacatacacacagtatattatactattaaaacaaattagtgctcaagaagagaagatgtagtgctattcttatttaggaaaaatatacagtattagcctatttgacatgtgtgtgaactaggggggcacgtccaggattctttttaatctgtgctccctctaactctccaattctgtcttctctgcctagattgctctcttcccctacccaccccttccactacaacttctgattaattctgcctcatcttttggatgtcacctaagagattgttttctttgggaagtctttcttgaattctatgggcttagcctgtatactgtaataggaggttttctctcaacatttatcatatggtagtgtaagtgctttgtctgtttctccctctaatccattagcaccatgaggcaggtaccatgtctgtcatgtagaaagttagttctaccagctgggcatggtggctcatgcctataatcccagcactttgggaggccgaggcgggtggatcacctgagatcaggagttcgagagcagcctggccaacatagtgaaatcctgtctctactaaaaatacaaaaaaaaaagttagctgggcatggtggcaggtgcctgtaatcccagctacttgggaggctaaggcaggagaattgctcgaacccgggaggtggaggttgtagtgagccgagattgtgccattgcactccagcctgggcaacgagtgaaactctgtctcaaaaaacaaaaaacaaaaaaacaaaaaacaataacaaaaacaaaaaggaagctctaccatgtgtagcacagtgtctggtatatagtggtcacaaaataaatattcattacataataagtaggcaaaagccagagcaatttggaatcagagtatatcagagtaagtcttagtatattattataagcaaggctttggctaaatggctcctttacctctactgatttctgctctatttaaccaggtatattaattggaatataggtttggctgcttgtcacagatctatgccagtttaaacaagaaggaattttctttgtcacaaaacaatccagagataggcagtcatggacaggtatggcagctttgttctttaggatattaggttggtcaaatgtaattgtggtttttgccattaaaagtgatagcaaaaaccgcaattacatttgcaccaacctaatagtcagaagcaggcttttacttattttttttttgagacggagtctcactcttgcccaggctggagtgcagtggcatgatcttggctcactgcagcctccacctcccgggttcaagcgattctcctgcctcagcctcccgagtagctgggattacaggcacccgccaccacacccagctaattttttttttaattttttggtagaggtggggtttcaccatgttggtcatagctggtctcgaactcctgacatcaagtgatgcacctgcctcagcctcccaaagtgttgggattagaggcgtgagccactgtgcctgggctccaggctttttctatcttgatgctccaatatcctatgatgatgccctcgttcccatggttcacagccatgacacaatcccagtaggtccacttttgtcctggaatccttggaacctacacccaaagccagtttaatttcttttgggtacctgaactgatttgaggaccttctggaccatgtaaggcagcttgagtctggtatggatttatagaattaatcaagttgaacaatttctcactgcttgtctaatccatgccttaccctcaagccttctcaagtgggaaagactaataacttagccttagttgggtatgtatgacaagaatgccagctggttcttatgccaaggtcaagcagccttcaaacagggtggtatggtttcctgaggcacaggatacaataagttaacagaagggcattctaacaagttataaaagagaaattgcttggaacaatgttaactatattatctagttagctatcaggaaaagtatagtacttatttggctataaggttgccacaaaataccattgcaccattatttctttacaatgcctttctgttgggtttatgttattctggaaataagtcattaattcttattacagaagtttgaaatgaaggccagcccactctatcagttctcccctcccacgatatatacacacatagcacagatagcacatgtatgtgtacacacacacacacacacacaatctctggagggaaggagagaagagagaggaaaatgggagaagaatcagggtaggggtgagagctgggtgcagctttctagagcattagctattcactcatctagaagacgctgaataaacaaaagtaactactccttcccttccccctccccaaactaaacattttcattctgtagacctcactttgtgtcctagacaaaacaggatcagtgtgggtcattatgagatgattctgccagtttaataggaaaataacaaaaagcaaagatctgtctaaatttgttcttggcaaaggcaacatatgagatattatctgatttttaaaaagacgttatctaattgatatacaatccacagttgattttctaaagtggtaaaattcacttttctttgtgttttggtgtgtctctgtgtgagtagttatatttgtagaattttggttaatttttgttacaattatatttccattatatatgtttttcttttctttccaccttctcaaaagttctcctttaaagcagaaactttccattcttggtttcatccaaaagacaaatatttctgggaaaacactgtgtttaagctattcagcaattctagtgttatgtaactgaccacactaagacttccaattaactttggttgtgttttattgaagagtgtcatagaacagaataactggtgataattttttaaaacttttctatgtttttaaacagggaaagctctcttaaaatatatgcagcatcttttgataagtgtggaaggtaaatctcctgtctgaagtattctaaagtccattgactgtattccaagactgatgctaatctgtctgacattgaggcattaattttcataactcaagttcttcttgctcttctttccctcttgctcgtttccctgattatttttgtttttccttcttcaatgatgagtgcatcttgagactctttttagactgcttctcttcaaaataagaatcatgtgaattcatggtttcaaataatttcccatgtatatgtatgtactaacttagaagtcgctttcttcatttttaatctttatctctcctttctaccactcttcaatatatccaatttctttatccccagaactgagctgatattttttccaaaagcctcataccttcccattttctctttatttttatgtcctcaccacaatcccagtggtctagtcttaaaaccttgcagttttgtggggttttttttttgtttgttttgctttactctgtcatttacttgcaacatgctgcctattatcaagttgtgatgtttatttttcctaaatatcactcggattcatttctttatttcaaaaccctgatattgcctcactcagcctaggtgataattatttggtgtgtacattactgtaatatcctcttttatgtcctttttctactctaagctaacctatggataagtatgagaatcgtcttgttcacagatgaggatactaattttcaccacttttattcaacgtagtagtggaagtcccagccagaacaatcaggcaaaagaaagaaataaaaggaaccaaactggaaaagaggaagtcagattctccctctttgcagacaacatgatcttatatatacataaaccaaaaaagaattcttagaactgataagagaattcagtaaagtttcaggatacaaaatcaacatacaaaaatcagttgtatctctatatgctaataataaactagctgaaaaagaaataaagcaaccccatttatgatagctacaaaaaatacctaggaataaatttactgaaggaggtgaaagatctctgcaatgaaaattacaaaacactgatgacagaaattgaagagaacacaaacaaaggaaagacattccatgctcatgtattggaagaattaatattgttaaaataataatactacccaaagcaatttatagattcaatgtaatccctaccaaaataccaatttttcttccaagaaatagaaaaaacagtcctaaaatttgtatgtaacaacaaaagagccagaatagccaaagcaaaaagaacaaagctggaggcctcacactacctgactttgaaatatactacaaacctatagtaaccaaaacagtatggtattggtttaaaaacagacatatacaccaatggaacagaatagagaaatcagaaataaatccttgtccctacagccaactggcttttgacaaaagcacaaagaacatacaatggggaaaggatacgctcttcagtaatgtgctgtgaaaactggatgttcatatgcagaagaatgaaaccagaccccatctctcaccgtgtataaaaatcaacttcaaatggattaaagacttaaacataattcctaagactataaaactactagaaatgctttaggacattagtctgggcaaagattttatggctaagacttcaaaagcacaggcaacagaaacaaaaatagataagtgggactatattaaactaaaaacctctgtacagcaaagaaaacaatccacagagtgaagagacaacctgtagaatatgagaaagtatttgcaaactattcaactgacaagggactaatatccagaatatataaggaactcaaagaactcaacaggaaaaaacaaaacaaaacaatcccattgaaaagtgggcaaaggctctgaacagacatttctcaaaaaaagacatacaatttgccaacaggtatatgaaaaaaaaatgctcaacatcactaatcatcagggaaagacaaaaaagaatgactattatcaaaaagacaaaaaataataaatgctggtgaggatgcagaggaaaagaaactctaatacagtgtaatggaagtgtaaattaggataaccattatggaaaacagcatggagtttgtaaaaaaaacaactaaagaaagaattaccatgcgatccagcaatgtcactactgggtatttatccaaaggaaaggaaatcagtatatcaaaggaaattagtatatcgaagggctacctggacctccatgtatatttcagcactattcataatagccacgatatagaatcaacctaagtgtacatcagtggatgaatgggtaaagaaaatgtggacacacacacacacacacacacacacacacacacacacgaatactattcagccataaaaaaatgaaattctgttatttgcagcaatgtggatggaactagaggtcagtatgttaagtgaaatgagccaggcacagaaagacaaatattgcatgttctcactcatgtgggagctaaaaaaaagttaatctcatggaaaagaatagaatgatgtttaccagagaggctggaaaaggtggagagggggatgaagaagaggttgcttaataggtgcaaaggtacagttggaaggattaagttttagtgtttgataacacagtaaggtgactatagttaacagtaatttattatatatttcaaaatagctaaaagattatttgaaatgttcccaacacaaataaatgttaaatgtttgaaatgatggatatcctaattaccctgatttgctcactgcacattgtatgcatttatcaaactatcacatgtacctcacaaacatgtatcaataaaaaagtcctcttgttcacactgttcatttatcttttaagaaaattttttaaaaatctgccaactggctactttattcccacctcatttacctgaactatatggtccacttctccaaacaaatatcatctctttccatctcctttcaacatgccatttggaagactcctctttcttcctccccaaacatatttctctatttcttcaaaggtggtggttaacacagccttaataaaagctgaaattacctggtcctttaagagcgagtaccacctgactcattttctcagtgtctcagggctacattgttagtctgccctgctctctttatctgtacttgctgatgtgtggctttgtaacatcatgtagtcattttctttatgccttttctctgcttttagagtacaagcaactttaaggtagagacaatatctaagatttatttatatcattcaactataattactaagtacttgctgattttgtttttttgagacagggtcttgctgcattgcccaggctggtgttgaattcctgggctcaagtgatcctcctgcctcagcctccctaagtgctgggattacaggcatgagccaccatgtccagccacacttactgagtttatagcatggtatctatctatatcaaattatttattgagcatctgctatgtgctaggcacagtgtgaggtgctagaaatacagtgatgagaaaaaactgacattacccatgctttgatagagttaacagtctaatgggagaaacgggagaaacagacatttatcaaataatcatacaattaagtgtaaaattacaactgtgatagagctacaaagagaggaatatggtactatgagagcacataataggggtatttaactgaggtgggagaggagaacagggaaggatgtcccaaagatggagaaccacatgagcaaaggctgtgtgaagggagggagccagatatgttcaagacattgaaagaagactggggtggctggagcccagagagcataggtagattagaggaaggaagctgaagaggcaggcaggggctaacctgggcaaggccctgtggcatatgaaaaggctttaggcttttatactgagcaatgaggagccactggagggatttaagaacaggaaaggatagtatggggttttgagaagatcactgtggtcactgtgtggaggataaattaaagtgggcaggaaaatcaagcttggtgtttttctatgttgtgtagcgactcagtaaatgttgctcattgactgaacagtttgtggggcttatagttcttgctgtaatctctatattatgacgtttggcttcaagctaaaaaatcttgagctactcaaaatacgggtctaatttttaacatagtctcctaagcatttgcaattcattgacctaacatgtagtagtaacagataataacaatgatgatgatagacaacattatctagtatctagagtttagtatctagtgtctagataatagaaaacattatgtatgctcctgagcactgtgctaaaggcatgatgtcaattatcttaattaattcctactataagccaatgaggaaggtgtttgtattcctatttttttttttttttttttgagatggagtctcgctctgccaccaggctggagtgcagtggcgcgatctcggctcactgcaacctctgcctcctgggttcaagcaattctcctgccccagcttcccgagtagctgggatacaggcacatgccaccacacccagctaatttttgtatttttagtagagacaggttttcaccatgttggccaggatggtctgaatcttttgaccttgtgatccacctgcctccgcctcccaaagtgctgggattacaggcgtgagcctctgtgcccggcctgtatccctattttcttagaaatacgttgtgcacgtgtaccctagaacttaaaatataattaaaaaaagaagaaataggcttagaggtgttaaagaccttgcctcagagagaagtggtgggactaggactcaaatctagttgtctctaactgcagagccttcactcttagctactttgttatagaagttctagtttatcttggttttcagtaccatttcaataccactattatgaaaaaggagattccttcagtcccacaaagagatatgatttagctaattgcccagtaactccttcctcaattttggtcaaagcctccatggcatcagctcacccagctcccattctgcagatgttttattacatgtcacacaacctggcattatttctgagttgatggttgtatgttttgatcttttcaaacatgtggacaaatttctggctggctgtccttttttcttttacagaaatatataattagatgaggtaataatgctcattagcccaagttacaaatagtatttcagtatccaacttcctccttaggagagcatcatcactgattaagaataattgccaacaattggccgggcacggtggctcacacatgtaatcctagcactttgggaggccaaggtgggtggatcactggaggtcaggagtttgagaccagcctggccaacatggcgaaaccccgtctctataaaaaatacaaaattagccgggcgtggtggtgggcacatgtgatcccagctacttgggaagctgcggcaggagaatcgcttgaacccaggagccggcagttgcagtgagctgggatggcgccacggcactccagcctgggtgagagagcaagactccatctcaaaaaaaaattattgccaacaattggtaaactattagttgaaaaatgtttgccatcatggccggaggagctctctgcctttggcctaccatctgctaagtgctatttgcttgtttcttctgtcttcattttctataccctagggcagcctcttctttagttgtaatacgtctgcctaaagtgggcttgtaatttgcttgcctaaatataaaaacgtaataacagagcattgagaatttttcactcataccttatagtatttctgtgataactaataaaatcagcttggtccctcagaaaatggaagcaacggcttactggttaaggagttttcagaggactggtcatctttaaccaaacatgactggctctttaccctttgcaaaggaaggttgaaagttcaagcaaaaagcaggtgaaaccacagttatcatagctaggaacaaccatagcagaatgcccaactgatagtggaaagctgaagatggaaagttgattggtaagcaacacaggctgcaaacctaaagaatagggagaagcatttcatagggatattggaagaaataaatagctttcatattgttggaggaaggaatcaagaaataccagatttatttgcttatgtcctccaaaaggttttatggatctataatctttattatagtttatgagtaaattattgcaaaagggcaattatcagttttgttcaaaagtccactaccagtgagtgggagaagtttcacattagtctgcttaggtagtggttataggtaagtagaggcaatttgtgctcagtagtactaaggtgtggaatggaaatcctgccctctcacttatttatttttcttcgcatggtattattattattattgccctctcaggactgctttcttctaaacttttgactgggcataggacattatagtgcagcattcagtttgaggatgacaaagccaaggccttctcatttcttaccattttatgttgatattgccatcttcaaggcaagtttttttaaaaaacaactttattgaggtatgactgagatgcagaatgctgtacatatctaatgtatacaacttgatgagtttggggataagtatattcccatgaaaccatcaccaccatcaaagccacagatatatcatcacctcccaaagcttcctccttcctcctttattattattattagtatattcttattattttgtgtgtgtatgtgaagatcacttaacataagatctaccctctcagaaaattttaagtatataatagagtattggtagctattaggcactgtgttatagacctgtagtagatccctagaaggtattcatcttgtataattgaaacttggcaccctttgaccatcaccaccacatttctcccaccccctcaccctgccaatcaccatgctactctgcttctatgagttcgactattttagattccacatgtgagaccatacagtatttgtctttctgtatttggtttatttcacttagtatgtatttcaggtccatttatgtagccacagatggcaggatttccttttttttttttttttttttttgacggagtcttgctctgtcgcccaggctgagtcttgctctgtcgcccaggctggagtgcagtggcaccatctcagctcactgcaagctccgcctcccgggtttgccattctcctgcctcagcctcccaagtagctggaattacaggcgcccgccaccatgcctggctaattttttgtatttttactacaggcagggtttcaccgtgttagccaggatggtctcgatctcccaacctcgtgatctgcctgcctcggcctcccaaagtgctgggattacaggcatgagccaccatgcctggcctccttttttaaggttgaataataattgtatctgcaatattttgactattgtgaataatgctgcaattaatatgggagcgcaggtatctctttgagatactgatttaaattcttttggataaatacccagaactaggattgctggatcatatggtagttctatttttaattttttaggaatcaccatactgttttccatagtggctgtaccaatttactttcccaacaatagcatatcagggttcctttttgtctgcatcctcaccaacacttgtttgttttttgataatggccatccccacaggtatgtgttgatatctcattctggttttgttgcattttcctgatgattagtgatattaagcatcttttcatacacctgttggccatttgtcagtcttctttggaaaattgcctgttcaagtcccctgtctcatttttaaaatcaggttggttcgtttgctgttgagttgtatgcgttccttatatattttggatattaaccgcttatcagatatatggtttgtaagacaagtttttattacatacttatttcgaagtacagtgtccattatactttcactgtccttacttttctgttatgcaatataatatcttgcccaggtaaaagtataaagaatactcaggttacaaaccaaaagcagtaaacaaatacaaaattacattaaagggaaatggtgtgaaagtagagagaggagatacatttttattcaatgcctcctatgttccaagtactctatcagatactttacatagtatatttcgtgtaatcctcatgataagcatgacaagagacaaatgagaaaaataaggctgtgagaagtgagggtcagactcttggttggcaagtcatccagagctggaatttaaactcatatgccatatgtcccatcatttacccagacacataaatatcactccatatcatcctacataagtacatgctgtcataatttttatattttttaattcttcttgcagccagagaggtagaataaaatgtagaaaaatgtggtgtcatagagaccaatgaatacataaataaatgaatgaatggggtatatatattgtatacttccatttctagacagactctattaaagaatcagcacaccagctgcttgcatttgctctttatctattggctctggtaaaactgtaaagcaagaaattttttttttctcccgtttgttgctcttccatacctctttcctcttatatgctagaacttttctgttgttactgtcagtgtacaccaaatatggcaacacaaaactattcctagaacatactaatgcttaaatatagatcttcccctatttagcagattttcgtgtgtacagtacattattgttaactataagcacaaagatctctagaacttattcatcttgcataactgaaactctgtacacactgaacaggaattcctcatctgcccctctctccagccccaggcaatcaccattctacttcctgcttctaagagtttggctattttagataccttatataagtgggatcatgtagtatttgtccttctgtaagtggcttagttcacttagagtaatgtcctcaaggttcatccatgttgttgcatatgacaggattttctttctttttaatacttaataataccacattttctttatccattcatctgttgatggacatttaggtcgcttccacctcttggctattgtgaataatgctgcaatgaacatggaagtgcaagtatcgctttcagatcttgatttattttggttaaatacccagaattgagattgctagactatatggtagttctctttaattttttgaggaaccatactgttttccatagtggctgcaccattttacattcctactaacagtgcacaagggttccaatttctccccattctcaccaacacttgttattttgtgtgtgtgtgtgtgtgtgtgtgtgtgtgtgtgtttaataatggccaccttaacaggtttgaggttacatctcattatggttttggtgtgcattttcctgatgattagtgatgttgagcactttctcatatatgtgttggtcgtttgtatgtcttcttaggaaaaatatctattcgggtgttttgcccatttttaaattgggtttttttttctattcagttgtagaagctcttaaaatattgtgggtattaaccccttattagatacatgatttgcaaatattttctcccattccataggtcatttattcactctattgattgtttcatttgctgcacagaagctttttagtttgatgtactttcacttctctaattttaattttcttgcctgtgcttttggtgtgatatccaagaaatcattgccaaggccaatataataaagctttccccctatatttttatctaagtcctttgtgttgctataaaggaatacctgagagcaggtactttataaagaaaagaagtttatttggctcatggttctgcaagctgtacacaagaagcatgacgccaacatctgcatctgttgagggcctcaagccactttagttcatggcagaaggggaaggtgaggcagcgcatgcagagatcacatggtgagagaggaggcaagagagagatgggggtcatactccttgtaacaatcagctctcactggaactaataaagtgagaactcacacaataccttgaggatggtaccaagctattaatgggggatttgcctccatgatccagacacctcccattaggccctacctccaacactggggattaaatttcaacataagattatgaggggtcaaacaaaccaaactatagcaattttctttaaggagttttatagtttcaggtcttatgtttaagtctgcaatccattttgaattgatttttgtgtatggtgtaaaataaatgtccaatttcattcttttacatgtgatctagtttttgtacaaatgttttcccagcaccatttgttggagagattatcttttccttgttgtatattcttggcatccttattgaagatcagttgaccacatatgcttgggtttatttctgggctttctgttctgttccattgatctgtgtgtctgtctttatgccggtaccataaagttttgattactgtggctttgtaatatgttttcaaatcaagaagcatgagatctccagctttactcttctttttcaagattgctttgattattcaggatccttcgtagttccatttgaattttaaggttatttttgctatttctgtcaaaaatacacttgggatttcggaagggattgcattgaatatgcagaaagttttggataatatggacattttaacatattaagtctttcaacccgtaaacacgggatgtctttctatttaggtgtatcagcaaaaaaaaaaaaaaaaaaaaacccttataaactaataaacaaattcagtcaattgcaaaataaagaattaatgtgtttctatatactaacaacaaacaatctaaaagtgaaatttacaaagcaatcccatttacaatagtatcagaataaagtaccttggaataaactgaaccaaagagatgcaagtcttgctctctaaaaactacaaaacattcctgatcttttaacaaaacttaacctatcctctcaggactctgttaggtcacgggaaggctaatgtggtaaataaacaccaactgagttataaatggcttactggtttgtcttcccacatattgaccaggagtactttaacccaaaggtacaggtaataaggtaatatggactgaactgcctactgatgaaatatttttaaatgaatattaaaaaatttgtaaactgcaacacacaattgctctatctagcataaagtctgcctctttttttgcagaacagcatttgtacaaaattacatacattgtgaggtgtaaatacaaatagttattcttggaaaacctctctgaaattttaaagtaattccatgagaagacatcatttcagatttcctagtgttgcatacataacacgcttttcactgagtctggataaatatggtttgggaggaagtacaataaggaggcagtggaatttttttggatcacttaccatgtgcttgatgatttgcatgcattatttcatttgatctctttcaaactctttcaggtagatggttgtcccattttgcagatgaggaaattaaggctcagggtagtagcattcaggttcactcactgcaaggctggatgtgaagctgtatccacttggcttgaagctagttcttttccctttacacactaggtggccagccagggaattggagtacagagaaaggtgagtagctctgaaacctgagtggggccttgtgaatttaagccgccctgtccaggaaggtttcctgggagagtgaggttgaagaaactgcttaatatccctgaaatggaaatatttcagttactgccaaatgtgtagccaaaaatcaggttaaagtagtggtgaagttaatcttacaggttgtttaactgtcctcagttgcatttcgtggtgtccaagatcacctaataggtcctctagaggtgggcctgggttcctgaggatggcttaacaagcagggaggtagggccttcacatgattttcctctggttcccagcaacattctgccctgatcatcatagaaggatttagtctatgtgtttttcgttcgtttgttttttaaattatagaacaaccacttcagcttgctaaaagggcatctcctctctatacagtgatggtgcccttaggttctggttgtatggggataacctggctgaatgacttgtagatgttctcaagtgtccacagatccttttgtttttgcttaatgtgcccttgctgtcatttattctgctctcctgggaacatcagtacacttgatttgctaaattgtcagctcatgatatatttaccattaaccaaaacccaggcttatgtcatagtatggcaattagtgggagacctatttttttttttatttgaaggtgattaaattcatttagggtgaatagtatgaaagacatgagccctaaaggtatttgcaatttgcatggaattctggcaggtgtcaagtttgactgcattatctggtatctcttgctgttgacttgttaaaactggatctaaaaaaatgtaataatcttttatccctatagcagatctttccattatgataaaactcctgctggtagtcatctgatgaagaacttttccctgtggctatgatcctactgtgtccctacagtacaggcaactcaacccatggtggctactcacaaagactcacagaacctccaggacactgtcagtcctagcaaaaccttaccctgctttgttcccttcccacccccaatggccagttactgggtaattggggtggtgaaaagcccagcgcgatttcctgttggcagtgtgctgatgcaggagagggtatagcccctgggcatggttttggaatacccgggtgtcctctgaccttatcctctgtcctaatgaaaaacttcctggcgtctagtattgcggctctcactggggtcattctgacttaattattctaaaatcaaaatagataataggcagataatggaagttttttggactttctccttccattgttttagcgaaggaagaagacacacacaaatcctccatcccacactcagttctattttggcacctggtgaccgtcaggaaaacctgataaacttgaaagtgttgtttcccaatcaccttcagaactggagaaacgctttcatgctgactttatccatgggactgaagaaagggagagtgtgctcacaagcacaaacaggaaagccttacatcacggagtggcgtggggaggagtctgctcctcgcttgctcgctcgctcgccgcgctccctttgtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactgagaatgaaattgctttggcaagctaaaatggtaacgagagctctctgccttctcccgaggcttctctggtggggaatcttctcccgctttcgctgggcgtgttttggactccctcggagtgaacggagcaatccgattccatacttgtgagctaaagctctctcactccgctttgtattcctctctctctgcgtgtcttctccctttcaaccgtacctactttctcagcaattgcctgtggtgtgtctggggcagatgcatgtcaggaggggagaactttgaaggaaaaagaactgttagtgtgggtgaaccgcggagcgcttctgcgtcccagcggctctttaacacaaacctcaggtttagctggggacatggaaatccagggggtcgctgcacagattttagtagaagctgcctgatgatgtgttgctttttctgcacttgccagattattttacggaaataaaaactttccacccccgctaactttgtgggctccaaaacaatgaggagaaaagacaagcaaaccacttcacttccaaaggagtgaggactcttggcgttttaaacacttgtttgtgtctgagtttaaaatctggtttcttcaatgaccgagccactctaaaaagtacagacttattcttttctttttttctttttctttttcttttcttttcttttttttttttttttttttttttttttttttttttttttacaaagaattatttttcctttcacttaagggggacaagttaatcaggactaatctagtttctttgtaaagaaaaagaaagacttcaaaacaaaactatttaagatatgtgagcaagtctaggagaaataactaaatggaaaagtcaggggatcctgataccacaggaagggactgcaagccaagaaaatctcagcattccctctatcaaaatgtgtcttgtattgcggattgtaatatttattttgaacagcccatcttgtgccctgagtgctgttgtaagcagcaaggcagctgggatagattgtggttagcagagaggaaaaaaatactctttttctttctctttatcccgtccctggcagagctcgattcaggactggggtgaagaggtagaggaaggagctgtttaccatgtcaccctcaaaagagtccagattcaacaggctgccaataaaggagcaagatggctaggggtgagtaaagctggcgagatggtgaactttggaatttcagtgtctgtcgttctgtgaatatcattattatttaacagaggcaggcttttttttttttcctcttttcgctttaaaaaggaaaatgctaatgaccaagtgtttgcactagctgaacaggtctctttttgtatttaatgttttcaaaagcatcttccctaggtttgtcaataattcagaacctcttagaaacatcttgaggtctttggcaaatagattgggggtggagtggcagaaaatgacacacagaatacaggcccagagagcagcactctcttagacaagagccataagcagctttgcccagaagccacccttgtctctctctgccctcccccaattgatgctgtcagcgtctgccttgctcctatatctctaggaggtacccagattgctcaggagacagagcattccaagtctgcatcctttgaggggtggtagatttcctattgtgatctcttttctatatcttgggaggaggcaaatggatgcttagtacccactactttgtgtgtagagtggtgggcctttggaaaaatgctgcttctgtaaacaggactcttttccactgagattgtaaaatattgggtgaggtcatgcaagtttgtaggtatcacctagtagatccttcaacacatcccaaataaagcgaatatgagaaatggaaagctcagcgacaggatcactacttgggcaaatgtcaaacatgtggaagaatgaagggattcttgatctggaaggagaagtagttctcagaccaggcggtgagaggcgacccaaaaagccttgagaaagaaaataatggttggctgaatagagggggtggagtgtgatttcacctggctggccttattttagccgatgggcttcagagtgttgaagatttatgcacttgcatcccatctttagcggcttggagtctctgaaaattcagaatattttgagcagcattcaaaggtggagtgtgaaggaggataggacacaaaattgcacagggcctcctgttaagagtagtggtaacgtgtgacttgtaactccagggagtttaaggcaggatggtggcccatggccggcagcaatcacttcctctgccatgagtctgctgacacaggcattcattgctttgggcttccccagctgcttcagctcaggcctttcctgctactgtactttgggccaaggtatcacccatgagggccagaaattgttaatgacatctgcaggtgtggtctggaaagataggagctttccagtgagaactagaggtcttcacttaccaagtacctaccttactcagaatatgattttaaaattaattatgtatatcactagcagacctgatagggaaagcagaactagagttctgacaagtcatcactttgtttttggtggttgtgtgtatgtattttatttaaatgtggcgtccatgtggtttggcctctagctatttcagaatgattcacaacttctgaaccagttgtcttcaaaagggtcattacatttttttggtatcaggttattcctctctttctaatgagactgactttgcttgggtgactgttttagttttcagccatatacaacattagttatgagtaagtcattggaaatggaggggttcactctgtaggccccacatctacaaactgtcatgtatttagatgctcagagttatttagtaatccccactgactgttctcttcactagacttcacttcttttcttctctctcccttctctcagtgttctcaaatttatacagagttcagagttaattcaccctggattcaacagtagatatgaaatactgagaaggaggataatgtgaaaagattggctctagttgatggaggaatctgtccccctcgcccccatttcaacaaagtgtgatttactgctaccagcctactcctttattgcaagttcctaggggctctccagctctaatctacgtgttttcttgtcttaggtgtcctgttgggaagttctgtttttgtccttgaaaattccagacttaattaaatgtgactcaacccattgagccatagcaattacaaacctttctctttagaactgagtggcttccccatgtttgttttcctgtattccagtaccctttcaaaattcttcaaagtaactagtttcagagttactagagagtggggtcaggtgaggaaattattgcaatatgacaacaaccttctgaggaaggtggtgttgtgatgatctctctctctctcttttttttttttttaacatgaggagactaatgcccagagaggttaaattgtttgccagggtcacacagctatgaagtggtaaacaccagattcaaatccagatggttggctctttgttgtgaagaatttcctgggaccttaaggctgtttccatagtagtagaaaagaacattggctcaaaagactgaggatgctttgggtgtgcttttccctaatgttgcaagactggagagatgtaactttcttttcttcatgtctagaatgataacttgagctgcaaattgagatatttgttgcgaagctatgatctcactgataaactccccattttggaggtttaaagcagggtgcattgaagatatgaagatacgtatgaggttatgtagcatgtgaggataggcatagctttgttacgtgtctgtaatgcttattccagatgcctaaaagatggaacataatttttgtattttctagtattcagatctcaaaacataattaagattcaattttggggaggagagcaaaataattacatatcctcagatgtgaagtattatacagtccaaaacatttaggtcattcttttttattttgtctgttaaattctgtgttcagttgatcttttaaagtaaaactctgtgtttggaaaactacaaccaagtatgtcccaggcccagtttacttgtacgtgcagctgcatccttgcccattgacggtgagattatattggcaactttgaaaaaccaaatattattgaaatactgacccattttccctttacaataacatctttggctgggataattttacccacctataattctcgaagaaaaatgacttcaattatgtcacaaaatttaaaaaatcttaggattggaagagacattaaagagcaattccgagcctagcacagtggctcattcttgtaatcccagcactttgagaggccaaggcaggctaatttgcttgaggctgggagctcaagaccagcctgggcaacatagcaagaccctgtctctactaaaaataaaaataaaattaaaaaattagctgagtgtggtggtgtgtgcctgtagtcccagctacttgggaggctgaggtgggaggatcgcgtgagccagggtggtcaaggctgtagcgagccatgattgcaccactgcactctagcctgagtgagagagtgagactctgtctcttaaaaaaagaagtaatttcacccagacattcacttatcttgtgatttttggaagagcaaagtgtcaaaacttgttatttgtctttggtcccagtgttgtggttgtatatggacagtgaataatatagaaaagagttaagaaaatatcagtatcctctggaagcaggaagtgtaacatttcaggatgaatactcaaagggacagaggaaaagaattcaactgtttgggaagggctttggtgtcagaagttcatgctgttgtcttcagaatatgacagactcagggtccaaaaaacatgtcagcctaagataagttccaagtgaggatattttttttacaagcaagattgtgagtgctaggtcacttctgcaaaatttgtgggcagtggaatgatcagtggttagtcacgtggctcttcttagtcctgtacttctgtggtcatgcagtccttgtggtggggcactgaggcctttctgccctgtgtccagtgtttgtcacaccgtttcccacataggctcttgataaatgtttgtgggactgagttgaaatgcaagatagatgggagtctggtaaagagagggaaatagaatggagaaagttgaatatatgtagaaataaaagaacctagaaacattaggtcatagaacgtggcatttgggcaaattgtggccaatcatgggttatgtggggactgtggtaagataaccatttgtcacatctggattgagaagttgactctcacttggatgttctatttagattgactctacctggcattttcatggtgttgctatccatgttgccttcaaatggcatacagttcctggagttttcagctaatttcacttctgggagccttctctaatcccccagctctggatgaggcgtcccttctgtgtgctccagaggcattctgcgtctcactgttgtgcatttacctcactctgttgtaattgcctgtttacttgtttgttatcttccattagactgtaagcttgcaaccatggccatctagttggcagaaactcaatacatgtttgttgaatgaataggtcatgcctcatccttctttgggggactaatattgtttttataagtatgaatgcatagttggttctcatttaaaacaaagtctacatgaagatgttcacttacaaagaagaagaaaggggcatgggagcaagaaaaatcaattaggtaatgattatagctgtcttacacccattcgagaacaaagcagggcacaaaggtatcaattattcattttaacgaacattccccagtgccttttaaaaccaagaggtccagttgtacttctcttgctgctgaatgttgaagaaaaaaaaggcaatgcatgagttaaaaagcattggctagcattacaattatgtgtggttggaaagtgcaggagtgggattttagaattgtaaggagataagccctagaggagcctttagtttatagttggtcatccttgttttcatctaggaaaacaggcccttgggttgcattatatgtgtctattggaatgtttaatttaggctttagaaagtagatttcagaatttagcagctatgtgtaaatgaaccaactggtatttttaattttgaccttagaaacacgtttttaaaattattaatccactgatagggtagcctctaccaatcaagaaaatttagtaaatttaaattgcctgagatattattacactggatccttttggtgctagtgctttcaaattctgttgggatctgtgttaggaatatgtgacatgtaatcaagaatatccatttcaattcaccaatccagggaatactcagctgagttcaaaatacatgtcaactcccagcaaatacataatggcataaatataagaggcacattaattccttatacttaaaagtgtatattctgttaaaacaattttatgaacatattttattcttatttctgtgaaatcataaagaaaaagcctcttggagttttactcttagaaagaaaatgagagaaataaggtaaatactgtgcctttccactttagagcttagctggaatttgtcactgcccaattccactccctttagtttcctttgcccatggtatatgtgtctctttaagcttcccccttctaaataatcagaattttttgactgtcttacgtattttatgttaagatatgcaaaaatgcactacatagtaaaacattctaatttgtaccatcatattctttttacataaaaaattagtttctataaacagagcaagaaaagttttggttaagtgggggaagataagaaatgttacttcattccaccagagaagctcagctctgtgtctgggttgccaatgggtgtggctatctcaagacgtagagttgatttggagttctttggagattttggcagtttctgggtcatttgctagtaaacacatccagtgtgaactccctcgctgctgttgcatatttctatatgattctgtcatttgcatttgagcctgctaaactctccttccataccattcatttattcatcaaaagcctgctttatgccagacaccatgttaaatcttgagaatacaaagtaaaatactccttgttctagaggaacttacaagtaagtgagggagacaaagttgaattaattacaatatattgtggcaagtgtgaccattgctaggggagcccagaatcaggggcatttaaatcaaatgcgagtgacaggtgggcagtccaggaagcctgcacagaggagagggcccttcagtggagaagtgacggatgagtgagagttaaatgagggctgggacgctgggggccagcattccaactagagagcacagcctgtgggaaggtgtggaggcctgaaatgagacttcccctgtgaggctcagcctggggaagagataagggaacccggtgggaaagggagaggaaagggggctggagagaaaggcatgagtcatgtcaccaagaacctggaatgctaagctatggaatctgcttcatctttaatgttagcatagtcattgaagagttttaagcagagtggcatggtcagatttgcattttagaacaatgactgacagctgcaggggagatgcatcggaagggagccagactggagcatggggacccaggaggaggctttctttagtggtaatgaagtgaagaaagggatgaggacctgactgaagctgtggcggcagagtggacaaggtaggtggggatgagtgtaggcggggcacagggcgaggattcctggcaggcacactggtttcaaagagcaggtcagcaaaaggctttctggagtcagtgttgtcctcttctcactgggtgaaatgtactggggacttcaagtcagccttcctccatatacactagcaaatgcctgcgttactgtcagaaggcttggcagaaaaaccagatccaggcatgcctgatgtgtcatgtctagagacgaaatcacagtttaggctcaccatgaacaaggcagaagccctgcttgacttctcagattccagagaactttgcagagttggtggtttctttttctttcttcctttctttttttaaagtcttctgtttccctacaaaccaaacaaattgaatctgaagaccatggagagagaataaatatggaacctgcaggactatgattacagagttgtattttagaaaacagcagttaaacttataattgtgttgttagggacacaagaaattttatggttaggtgtcctggtctttttccatcttcctacacaatgtgtttaaattctgtctgatactctttatcctagcagctgacattgctgttcttaaaggctcactctgattgctaattctcactccttgtataaaagaaaaatttcagtaagatagaatgcttccctagtttactgctacctcctctcagtctcactcactctctcacttaaatacacacacagcctatatattaaaatgtcttttcacattttattttttaggatttggttcaccttataatgtcacttatggcctcttctatataattgatcaaagcttgattttgtcatgttttgcttgatttcccttaattgtgtcattattgagattgtttgattgactttactcagagaactgcttttagtttaaaaaggaataaaaacagaggaagaaaggaaggactaaaagtagaacaagcttacaacattgggtagaagacaccaccttgtaggaagctcagttagtctcatacagagagagagagagagaatcatgtcatttcccactgatccttttgtcttgtcattgtagaaatacctgtgtctttccactgatgtgactgcatatgtttcccaatgctttgggcctctgcttggcttgtttcctcaaaaccaccttctcctttatgttatgtggcgtatgacttctgaggataacagtggtggtggttgggggtggggtgttgctggtggttctagatcttttttaaactctcacagactcattaccctacattttctagcatgtaattgcttatgccatctgtggtccattcatttgaatttgtttcagcacagttaatctaatcctatgtaaactcccccagaagttttttatgtttttcttttctgcaaagaattcagcaattcaacttttttcccttgtttcctgctgttttaaatactcattttcatcttttataaaaatgaagccaaggctgagtatttccagtttcttaattctgaagacaatttgaaggcaaaaagcaaaccttttctgctaagggtaggatgtcttaggtcagtcatatcaactgaatctctccgcaaccctcttgctagtaattcttccatagttatgtgccattcttattatgcccataacttctgtcactaatggtgatggagctagagtctgtggacaatatttatctaagaaaagaacatttaagtatgtaggtaaaaataactgaaactggattagacattggctaaaaataaaatgctttatagtcatgacttttccaattaaaattgcaatacttggctgagcgcggtggctctcgcctgtaatcccagtactttgggaggtccggatgggtggatcacttgaggtcaagagttcaagaccagcctggccaacatggtgaaaacccacgtctctactaaacatacaaaagttagccaggcatggtggcatgtgcctgtaatcccagctgctggggaggttgaggcaggagaatcgcctgaacctgggaagtggaggttgcagtgagcagaaatggtgccactgcactctagcctgggcaacagagcgaaactccatctcaaaaaaaaaaaaaattaaattgcaatacttgaaattgtttattgagataaatgatactcctaaatagaaaactgaggtaattgaagcatttggttagtttgtgaagcacagggaaaagacttgccactttctgtccaaaggctgattccttctaaagacatgacacaataaacatgtctgttttaaaaatgactttagggcccagagccatcaaggcctggctagggaattagctcagttggggacttcgtagacactggcacctcctggctgcttttcattttcaggggtatgttcagcaggagccctggaatagggaggtagcttagcacagtggtcaagaacctatgctttagagccagacttccatgcaaaactcacctctaccacatgtgagctatacaggcctgagctgtgaagttacttaacctctctaggcctgagctccttacctgtaacggggagaatagcagtgccttcctgatggaatgactgtcaggagtaaatgagttatgtatgtaaggtgctaggatatggtgtgcactcaactcactgagtggtggggctctcgtcagcacccccaccatcagggccctctagaaccctgccatagaaccttggagagacctgggtggctttcttacatggaccccctgaagcttggtgttatatgtaaccccaggttgcttaagaaacagtattagcaaggttttaggacatgtcattaacatccctctctcattttgtacatttgagaggaaggaacaatcatggcagggtttagtaatcctcgtatattagaaataacatctattgtattttatctctctggctccttgcataatgaaagactgcattattcctcgggctccaacattttgcatttgaaattccttcagttttctaaagtaatttgttggtattatttttatgctttaaaaaatattttattacttaacagtgggccatattctgtcttctgttttgccatttctgacagaaaaatcagacagtcggaaacaatttttctaaaaactgcttggtaagcattatgctaatctttcttaataggacataatttaggatgttagtaaattgttcttgcaccatcagtttcaagtcctggactaaactacatgagataaagataaaatttcttactgtgctacacgttgattagcttatacagtgcctgagccccactgcctcagccaggaatgagctgagttgcttgtgaggttgtgactttctgaatcttccatttcctcacctgtgaaatggcgttaatatctgtttttactctgcctatgatttttgtgaggatcagatgagttaatgtgtataaaagtattttttaatatgtaagtttttatacaaatataaggatattcttactgtcatttaacctagaggcctttttttctctctgctcactacctaaatgcttgataggcatgtggctctgtttattagtcttgcctttcttccttcattccagaggcaatcttttctactttgttttcttcccacttgctgccacttgctgattaactaatgagaggtgatgttcagctaggaggagtgcttcctctgctaccaccgttgtccccactgggattccaggtgcatcgagaatgcagacagcaaggcttctgtttgtagattggttgtgggaaaaaaaaaccccatactcacaggattcttaagacaaatgcagtggatattttgtgtttgaaaatgttctatttcttctttgattcttccttttctttctggtacttttaatttgttgtgagaagggtgataaagctaataatgcaccaaggaatggaaagtgcttccatctttgcagaggtcctggaaagttaacttttggtctgaagccaaatcccgatgtaggacttgaactcatgacctaatcccagaggcaagaatgttaccagctgaccaacactgaccctcataaaatgtagacatttaaaatactcctttgagtagtcctgttgctgctttctatgttttcttctctctttcagtcgtttccagcagtgttcctggcctccctgttaggagcacagttttaaagatctatttttctcactgtctttccatttgctgattatagctgcttccttcttgctttccatttctcttgtgtgagttcctttttttgttcctgttccttcctgtccttcttctgacttaaaaatagattccagggtctttggctgctcggccacaaatccgaccttccttctattcatatgggatccccctgagcatctaaagatcttttccttctctctcaagatacttgaaccccagcattcattccctgttctcagctgacttgtggagctaaatgacccttgtactcagagctgtaactgaaaattaaatctctcctacaaagatgcttaataagtgatttacttatgttaagtgttactgacaaacactgaattctccctgaatctactgactgtgtgtggtggtagaggagaagggactctttgtacactgactcaaggcatgcgtgtaacactcgtttttgtgcaaagcaatggtactgtgaccatttgaacctcaggaaccagctttcagacaacgtactgttaagggtatcctggagggacctgctgctgttttgttcccacagaagtgtttctcagggaccgaaagttgattaaagtgtttcctcatgaacattctttggttagagttggaggattatgatattctttacagaaatgacttcctatccaatgttgatctagacaatccacaaatgagtgtctgctcgagggataaaggcttgtaaaactttagatgactgggataaaaagtgctgatgacagcagctctgatttcagtgcccaaccccaacctgaaatcactattatgctcttgttacagcagcagggatgatgatcctcttctcagtggcaaaagagttttaaaaggtttccttccatctggacctccagacataacctatgtggttatgtctccatgaaaagacctggtcctattcttagtagagaatccggagtttttggtttcatcagccatagtgaagttcacatttatgtgcagctctcttatcactgtgtcactgcttatggcattgcatttacctgccctgcttttctgttcactggttgactgatgaatcctacttaaccctttaagttgcagctcaaatgttatctttactcttctacttttcccaacctctcttctggattaaggatccttttatctgagtttccttagcactttaccaaaagctgtattacagcacttatcacactattaaaaaaaatgtttctctttgccctattcgtttcagtgtttcatgaaagggcgggggccatatttaattaatcatcatattcccgtaacctgggacagtgtttgagacatagttagtacttagtgagcatcttataaattgtttggccttatctttattatagaacgtgtatctttagtgacttttttttggtatttggtaatattgtaagttccattttttgaagcaaaaggaaaacattgaagcagctaaatttagcttatattttatactccaactactgataacaataaaaaaaagaaagtgatgcttttgcctcatctttgtcatcattacttgacctacacatttcatgattgtatgaaaagtggcctaggtatgacagtaacctttatagatgggatgacttggaatttagagttaatccatatacttcttagtgacatataggtttgagtcatgggtcaaggatagacctctgggaactcagtttctgctttgaattctgaagttattctacttaggattttcatgtatcttattatatctggtatctgaggcctataattggcttcaaacttgcattgacccactgtcaagccaataaggctttgccctacataacacatttttatgaagggatctgacacatctccatgaacatagtaatgaaggttatgcccataatgatgaggcctgttactctgagatttatgttgcaggcttgtcctgtagtgtactttgtgtggtgcacctttcttaccggaactcacaggcaaaaggagacttaataagtgacataaattacataatattttgggtatacttttacattttcattagtacaactcaattcccttgctctctggccctccgacacttttctttattctgtggttttacattcttaagtttgaaattttcactttaggcaaaatgtaaagtttatgcaagaggttttcagaattctagaatttcagaattctgtttttaggtgctttcatttacattgtcccaaatgtaattggctccattaaaattaagtgttctgatggcttctgaaccttcctgcatgcttccttgcctttttctttgcatcggtgttcaatggcataaatgtttgctttagaaaagaaggatggacttttttttaaagcaatgccattcttaaaagagtgttgaagcaacattatacttttttttttttttttaagagacagggtcttgttctgtcgcccagtctggagtacagtggtgtgatcatagttcactgcagctttgaactgctggtctcaaagggttctcctgcctcagcctcccgaggggctgagactgcaggtgcacaccaccatgcctggctaatttttaaattttttgtagagatggggggtctcgctatgttgcccaagcttgtcttgaactcctagcctcaagcgatcctcccaccttgggcccctaaagtgctgggattacaggcgtgagccaccatgactagcccattttgttttgtttcgttttgatttaaagaagaagaaaatcatctataattctgccatgataacacagttcttttcacttttacttattatcttccaatttttgttcacaggcacacattttaacatagttgcaatcatgctatctattccgtttgtgataggcaggaaatatttttcagaacaaattagaaaggttactttctaatttgaatcgtttgtgatatttgttatgtttctgatgccacagacaaaagaatgtatttggacttggtgtttgaggagttttaaggtgataatgcttatttattggttaatgagcctcatttctgttttttacccccacgaaatctcccatcctgtatcaggggtgtggggcttgcatgaggaccctgatagcaccatatgagatgagggcatgtgacaaacgtgcagtggaattcagctggagtggatggtgctctttccttctgcttctagacatcattgccactctcttgctctggaggatgtgggtccagaactctctaggcctgtgctgttcaatatggtaacaactagccatatgtgcctattgagcacttgaaatatagccagtcctaattgaaatgttctgtacctgtaaaatccgcaccagagtttgaaaaaataatgtaaaatatctcagtaatttcctatagtgatcacatgttaaaatggtaatactgtgggtaaaatgggttaaataaaatgtatcgttaaaattaattttatggctgggcgcggtggctcatgcctgtaatcccagcactttgggattacatacaccaggctgaggctggtggatcacctgaagtcaggagtttgagaccagcctggccaacatggtgaaaccccgtctctactaaaactacaaaaattagctgggcgtggtggtgggcgcctgtaatcccagctactcgggaggctgaggcatgagaattgcttgtacccaagaggcagaggttgcagtgagctgagattgcgccactgcagtccagcctgggcgacaagagcgaaactccgtctaaaataataataataataataataatacttgtacctgtttcttttcaatgtttttaatttggcaactaaaaaattttaaattgcctatggctagcattatatttctactagacaatgttgctctcaggccttacttttcaaaatgcagcttgtggtttatttgtgggttctgaagtcagttaggtgggctaaaaatcaatattttaaaatcagaacagaatggaatagaaaatattagaatgtcattattgtaaaactttttgtttaaagtatgcatgtgtggactggatcccatgtaaaatgtattttttctttttactatgaatcatggctaaaaagtttgaagattagtaatctggggtggcctgacttaatctgaagcattaccaggaggcctggtctgctctgtaagagggcaggttggtaccaggaacactttatagattttaggtctggttggtaaaagctattctgggactcttcaactagaccagaccctgcaggaaagtaaacctgaacattagtgctcatcctaaaagcagtggccactcaggagacttccagagtgaagggtgaactaaggatagcttactgaaagctggacctgtgtgctcaaccctaaagtgtccctggagtccaagaatgacttttgtctggttacttgcttctcggagactttttcaaaatggtctcatgagtggtgatactttctaagaagcaggatgatttcctaatgaccttagagccaagatgaattggacagggttccttgtgaccctcaggtcctccctgcatcatatcctgttgaaatcagaagagactgtattctaatctagaagcatgtctgtcttcttcctgcctgacagaaaacatgtccttacagtacaaaagatgtaggggtggtcaccagagctgtacttttggctgggttctaaataaatgacactgtaagccacagagagaagggagaaaaggctccaaaaatgaagtttatggggttacatgggccttgtatttattctgacagttgtaaaaattcttttgggctgacccatttttcttttcttaattaaaaaaaaaatatctggcaggcaagaggaagaaatgtaaaccatgtgactaatgcttcagctttttctcctggagccagattctttaaaaattataccttagacatgtttgactttttaaaaacaattgcccacaaaagccaccaaacattttttttctgaaacttgtagacttagatagcattcattttcaggaaggaatccaaaagtacaatatttaggagttattgaaccaaaatctcctttggagattttgccctggtgaattagattaccctaggaattggcagaggaacaggcggccttttgcctctactttgcttgagtatttccagtcctgttggtagccacccaaaatgtttgagggagttagactaaaagatcgtcaaggtcctttgtagacgaaaagtactatgactccagtgacggaatgacatggcagtcaggagttatgtttatgttgacctcttgttttatacttattgcaaacaatttgtttgtttactcactcactcaaatttgagcacttactatgtgccaaatgttggcctttgtaggaaaatcataggattttagagcacttatcatagtagatttgagggcttcaaagtcaagttccaatctccctttctggggtgatttcctatgtctcacttttgcaactccacacttcagctaactgggctattttcctgttttagggtcttttctcttgctgttgccagggtctaaaatgtcctcctttccttaatgccagacatctttaaatcgccagacatcactcaaattctagctcaaatgttacttctgtgagtcctctctggtttctcaaaaggtagtaagtgattcttctctcaagccaaagcactttgtacttcttttttttaacaccacacataatcttcttagaatgaactgtatgaaatcaccagttttataagttaaaaatggttaaatattggcagcttcatacagttccagctaatattaactgtgttattgtatggaacttaaattaggcctctataaatatattgcccccaagacttatagccagaaatattcttttgtcttttcttcaaaaatatgagttattattaaactaagtttcattaaacctgtgcttgcaagtttcatttaaaaaattaaatatagaaaatatttatttttaattttattagtcttagctaatcatctaaaattttgattcagtaaaccaatgtattagctataactttcagtgtagtttaataaggttctgtataattatctactttatttgttaaaatgatttattcaacatggctaaacataaagctctgtgatatattgctggagacattccccactcccagcaatactcgccagttaacatttttttcaccattcagtattccgtgacatctgatttggatacatatctaggcaactctacaattattcaacttacggagttccactgtagctatagagatctcaggagagagttggtgggatagttatttgaagtcaatgaatatcatgtctgtagcattccatgttacctgtatagaatcagagaaggatggaaagttagtttgatatgattttttttcttttaatttagagacagggtcttgctctgtcacacaagctggagtgcagtatggtcatagcttactgcagcctcaaacttctgggctcaagagatcctcctgtctcagcctcctggatggctaggactacaggcctatgcaatcccccatggctaattcttttaatttttttttagagatgggccttgctatgttacccaggctcatctcgaactcctgggcttaagtgatcctcctgctttggcctctcaaggtgttgggattatgggcatgagccactatacctggctgattttatttttctcggtgattttatgttagttcctagtgatcgttgcttacaaaccaaatctgggattttgggaacatttgttggcagaactacccatccgttgttttcagtctaccttaattgctgcctaaaaattggtataccttcttgtacaccctttagacaccactgtgattctaatttctgtgaagattccgctcatcacatctgcttctccttttagtgtccttccaggttatttatccggccctggagacatgaaatcacttgaagggctaagtgctttcttactatcaccttctctatcttgggctttagtttcctcttcaccatgctggtcctaccctttccagtttgaagatcattttccttgatagggaggatagaagcaaaagaggagtgaagtagttctgctttttctttgttatcagttaacattaccccacctatcagcaaccactgccttcctatttttgctcctagaatagctgaaaaaagtccttttacttgaccttaacaattttgacaaggctcagttcattatactattcactttcatgttactgtgttttataaatatgtgttatcctaagtatatgtatagctttaattatgggacctgctttctatcttttataatttggaaaacatgtacaaccaccttgatctctttaggtgctttctttcattgcatattttaaatatttgtctcacctttcttgaagcctcttgcctgttaaagaaggtttatataataatgctttcctaatgtttgggatacatgtctgacacctgtacaagaaatgtaatcaccctccgccaaggtttctatatatcctgcagcaaccatttttcataactgagcataattatgtctggactaatagttatttttatttcctcctatcagtagagtagataaaaacctagaagaaagcattgatagctattggtgagtgcttatatactgagagggaggagtcaaagataattccaagacttttggtgtatttgaacaaagagaacagtggtatcattagtagaaacagggattctgtgaagaacttctttgtggtgctggtgggagggtagtgatatagttatttgaattttagacatatcatgctggaagggtttctggattagaagagatttgggattagaggagtacatttgggtatcatttacacatcagtgatactttaagcagtaagaatgaatgatatagagaaaatggaaaataaaagagtattgcaggccaagtgtgagtaatgtcatgttcaggggaccaaaaggtagagaccggttagcctaggagtcagaaaagcatagctagggaggtagcagcagtaacaggctaattcattggcacagactttaggggaggccaaagttttaaatacataagactgtgtactctaaaaacaagtaacatcctgtcacttttggtcatttcagctttccaaagcatattttaaaactgaacattaatgaaaagcttctctgagtaacccaaatagctctcatcccataggaaaggccaggaggttatcattcttaatgcatatcatatcaattctgaatgcataacaaagttggttgtttatataaagtcataatgaagttccttgttccagttgagtagaagtagcaaatctgaagaaagtggggcttttagaagcagacacactcatagcaacaaaaactgacaatcccagtggaagcctatgttcaaatgtcaccttcttggtaaggccttgtctaatcactcatataaattgcaaccatgaaggccagacgcagaggcccacacctgtaatcctagcactttgggaggctgaggtgggaggattgcttgagcccaggagtatgagaccagcctgggcaaaatactgagaccctgtttctatttttaaaatcaatcaatcaatcaatcaatcaatcgcaactctccccatctctgtctctctctttttttttttgagacggagtctcactctgttgcccaggctggagtgcagtggtgcgatcttggctcaccgcaagctccgcctccctggttcatgccattctcctgcctcagcctcctgagtagctgggactacaggcgcccaccaccacacccagctaagtttttgtatttttagtagagacggactttcagcatgttagccaagatggccctgtctctattttttaaataaacaaatctcaactccccctaaccctgcaactccctatcctccatttcagctttacttcctccttaacaccactgtctaatatacctttttatttgttcatttgtttcattgttattgattgattgattgctgcttcgtacattagaatgtaagttccatgaggacatgggttttggttgtttttttccccctgctatattcccaaagtctagaacagcacctagccgatggaagacacgtgattatttgtggaataaatgcatgtaagaagaagatgatgatgaaataccaggcataaaaataagaaaagtgtataggtatatagatcatttagctttggaataagcacttctatttatgtcagtttctctaggggaagatactacagttcattgtagcactgatggcctactgagctgtaaatgaaaggttaaactgtgctccggatgttctgcttttgaaggcagaaaaataacatatttcagtaacattttaatcaaataaatgaaacttttagaatgttgatgtttaaagggtccctccttgggaaaataattcctgtattgaacactaaattctcccatgaatgaccattattatgtgatttaaatgtacctttttttttcttttcttttcttttctttttcgagacagagtgtcactctgttgcccaggctggagtacagtggcatgatcttggctcactacaacctccgcctcccaggctcaagcaattctcgtgccttagcctcctaaatagctgggattacaggcatacgccaccatgcccagctaatttttgtgtttttaatagagtcagggttttgccatgttggccaggctggtcttgaactactggcctcaagtgatccacctgcctccacctcccaaagtgttgggattacaggtgtgagccactgcatccggccgtgtgccagtttcttaaaatttgatttttccttaaccttattgacaccctgaacaactttcttgcaggtccactggaaatgttaaacgttttgcctccttttttttccagtctcagagacctttaacccaaaggtgtggaattaacccaaaggtgtggagctacagagaaatatatggcagctaaacttaaaaactgttaaactggaatctctcccactggttttgctttcacagactgttgctttattgtaggacgtcagtggcctgtttgttactctcatgtctttttggcaaaatgaatgagtaagtgcttctaaattactgtgagatgcctgtcgaattgcataagtagatttgaaaaatgctgtattttcgattaaggtatagctgcaaagcatagctcttcagttcaagaggcgtagcctgacctcctacacattttacccttctccacagttgcctcttagtccttgaaaaaacatttttttcttattccctctctttcattatttacgttggatacaatagctgtgtacgctatttccctggctcaatataatataagtttttaaactttacaatctatggtagtgactgagaaaaactttttaatgtgaagggaaagtgtccccactttaattagaatgacaaagcagtatggagttatgtaataggtattcatgcagctccattggttacataatataatggtcactcacaacagatacttaaatccatttcacatccaggaccattgtgtccacttgcagagacagtgctttctttgttttcaccaaataaatagctagtgattattagcttagcttttaagttaaatcacattcctggaaagggaaatgttgcaacttttttttaataggagaggagaatgcatttttgaaaatccaaacatactattactgccagtgatatgaccattacacctctttgacaagagaaacctatgttttatttaatttagacagttataatttcacatagtcacatgacctttatcctgttaatatgcaatctaaatatttgtcttcaaacggtttcagtaacatggaacagccatgacttaatttgcctacgatgatgtcttttcccttccagcaccccgtaagtggaattttgacttgttgctgagtttgtgatttatttacagcatctgacatggagtaggtcttaactacttggcatgtgtggagtgggggtagagggcagcacgtggggatgtcttcagtgagcaaatggggggcctgacctactcggccgtctggtgctgctccttccgtgaggctttggagtctgagggatctgggttctgtctttcgactcttggctctgtcaattactagtaatgtgaccaggtggattgcttgtcctgtttgagcctcagtgtcctcatctataaactgagattattgtgagtatcaaatgagattgtgtatttaaaagggcttcgaatattagacacaaccaaagataatgattcccaatctgaaatttactagtcaaaaatgaacttgtaacactgattgacttctgtattcatttcctctgatctgctccagtcaggaacaagttaaagcaagtgtatgcttctactcggaataaaactggtatcagtcaatgacaatggaaaaagaataaaatttgcccctttctatgggtgaggaagagagttggagaggagaataataacactgtgctcagtagaagcagatgactttacttcagtcatggtttatttcattttgtcatcataggaatttctctaatattgttaccatggttcttaatcatcaatgcttgttataataaccgggattgaatgcaccttcttcagttacagggatttggatttagggagttggaggtggggcccgtgaatctacttttaacaagtaccccaggtgattctgatgaaggtggatcagccaggcatggtggctcatgcctgtaatcccagaactttgggaggctgaggcaggaggatagcttgagcccatgagtctacctgggcaatatagtgagacctcgtctctatgaaaaaaataaaaaaattagctgggcacaatggtgtatacctgtagtcccagctattcaggaagctgaggtgagaggattgcttgagcctgagaggtggaggttgcatgaaccatgatcatgctactgcactccagcctaggcgacagaacaagaccctgcttaaaaaaaaaaaaaaaaagtagatcgtgatcaacatttaggaaattttgctcccatcactgttgctttctccagtagttttctaagtgaatcttttctttttttcatacagttcattcttcatgtaaactcattcatcatgatatactcatatttacacttacatttgatcctgataatacccacctgcttaaaaccctttaaaagcttcacattgatactaagttgagtatcaaagctcttctggctgagcttccaccactctcccttggttcactctcctttggccacatcaacttctttttatccttcttgtattccaagttacttcatggcatttgcacatgctgttccctcccctgaaacgttctctctctcaccatttatctggtgcacacctactgattattcccatgtttcctcgtgaaatttatcttatatctaagacaaaacctgatcctctcatgtttttaagcagctttttatagggagcaatggtttctaccgccattagacagttgttaaattatcttctctgcttgaatgttggcttcatgaggatagggagtgtgtctgtgttgttcatttctgtatccacagtgtcctataatagtatgcagaatatagtggaagctcaggaaatattctgaaaaatgaatgaaaatgggatttgtggcaaagaagtgatgctctagtcctccacttatgaggatttaatgactgatgcagtgagtgggcctttttataaagtggcaatgcgcctaacttagcattctagaatgagatgtttatttcagtgataaaaacttcttataagttcagacacctcaaacaatatcctttgtgttcaacgcttagaacctggtatgggaaaaaggggaagttataaagatttcagatgaaatcctgacttattttgcatgacatctttcatgcagaaagtattggaagctgcttggtagtccaatgcctcacaagtaaatttcttgcaatgtatttatttatacttatatcacatagctggttgattagattgtgtattcatttcctcagatactcccacttggagtggtaaaaagtcaagtaagtgcatattcccactctctgttttcgaagcaaacagttggcccagtggcatctacatcagatagaacaataagagcaatgtcagccccagagaatgagagatctttgttatgtgtagcttgattcagcatctcaatcttgttgggaaaagaattctggagaaaaaaaaacccatgacttaagtaatttttaaaatcatgataaccaaatatagaattaattggtcttcaaaaaaatctcagaacagtcattttaataaattcactgcagttctcaactgctatgaagagatgggaccagttaattttgtttacttgaaatttttagttcagaaaaacagatttttgtatttttcaaggtatccatggagtttcgcatgcattgaattcagatttaaaaataatatgcaatttacttacagtattactttgttttccattcattaccacaaatatttactgagcatccattatgtagtagacattattttatgcaccagagacacagtggtgggcaagacagttaagggctctgaacccatggagtttacaggcaacaaacaagtaaagaagtcagtactatcaataaattagtctagataaggtaatctggtgtggcaggggaagatgggaagtgtgacactgaccagaggggtgctctagggggtttatctgagtaagtactgcccaatgaaaagaaggcaataaggagccagtctgagaacatgctcaggctgagcagcatttaaggcagatggaacaaatgcaaagatccttccatgagaatgagcttgctgtgttttaggaactgaaggaaggccagtgtggttggggcctagagagggaaggagatggttttggtagtgaggtcaaggagataggtaggaagggctttgtgaggtctggcagaaggctggatttcatttaaaggattatgggaagccagtgggaggttttaagtagggagtgacaccatctgatttgtgtttttaaaagatcaccatggatgccataagaacaatttaaaagattgtttattttagcagtccagctgagaggtgatgatcaagcattacatgcttttattgtatatgtacagactttatatgtacatatttttatttgactgaatttggaagaatcaagtaaaggttatttagggactataataatgtcactagatagattcattacattagaaacatatccatttaattaatattcatgaagagcttattgctgatttggttgaaggccaatttctagagatttaaatatgaatagtctttgctcttaaaaattttacagtctagtgcgggatacctataattaaataaatacaacctaatatgggaagtatatggctactatgaataaaactgtaataaatgtttctggccatgtcttttggtgggcatatacactcatttctgttgagaatatgtctgagtgaattggtgaattataggataggcatgtcaagctttagtagcttgttggactttattataaaagcaggatttgtactttagaaagatcattttgtatatggatgagtggttgaagtgataagactagaggcaagtgagactagttaggtgcctattactcatacccagttatggactgagatgtaaattaaggcaaaggcaatgaggctgaggaatgagaatgaagtgggacgatataggagatggaagaggttggattttggggggatgagggagtaaggatgatctgtacatttatgacttgggtcattaagtcagaggctagaaaaggggtgagcttttagaggaataaaatgaatttccttatgtatgtgttaaattagagttgtctgtgaattattcaggtgaatgtggtaattggaaattcaagtctagaattcagaagagaagtaaaagctgtagataaagctttgggagttaatataatatttgtgttaggtgaaactctaaggatatatgtgtgggatgaccagaaagagtatagaaaaagaggaaagaaggttgtggttagaaatgtttccatattgatggtaagtgaaggatgaggaactgttgatgagcctttagattcacagaagatttttgaggaagatgagatagtgtggttaagtctgactgtgggtccagactgcttgaatttgaatcctggcttttctgcctcttagctgtgtgacctggaatgagtcacttagcctctctgggtctcagttttcttatctgtaaaatggggataataaatgtatctgctttataaggttattataagatatatacaaaatgcttggaattgttgttgttattgttattcttgagaaaatgatgtttataaggaaaaggtacagagtttcaggcgggaatcaatagtgccgattctccagggatatcacaggaggtaagtgctaaaacatttccataggattgacaaccagctggaagagtaatgggggcagaaacaaactctgtaggctaatcataataccgtccctttttgtaggaacacctattgaatttcataacataaacacacaagcaagatcacatggtttgcttgaaagcctctcaggttattgacataagtgctagtaataccttagtttaatatatagttctttaatttaaagcagctcaaagtgtatcctgtgttcttttgaatcaccctcataacatcaaggtgagttaaggaagatgaagataatattcttagtttacaaatgaggaaactaagactaagagaggccagatgactttatccaagcttttattaatcaacttctctgttatcccatcaataaaccctagtcatccttgttttcacattgtcaagcatagtatagctcaaagggtaatcaatagagattctgcagtttagaatcacctaggatgctggttaaaatgcagaccacctagcccttgttctgggtctactgatcggaatctctggggcatgggctcaggaatcagtttctgcccagcactccaggtgaatctcttgaaaaccctttagtgtatttaagagaacaggcaaatagatccataaatgtatcttgtttattagtgagatttttcacaaaaaagtgttaaaatattttgtattcagaaactcaggctactataactaaaaccttagaaccttgttctgaacatattgtatgatttgctatatttttgcagttgaatagtacttttggttaaaagtaaaactgatttgaccttacaaatgaataatagaatccattggtaagttaccacagcactgctggagaagtcacagagaagctatggctgaggactctattttatatcgattcggttaatggccctacctgcagttagtatttttagttatatagtattgattagaaagagttgctccccctatatttatagcttcagtatgcatatgatgatgaaatgagccatatctctctctgtttttttttttttttagcatagcagcataaaactctgaggctcaggtagctttgaagactgtctctaggaggtgggacctcataagagtctaggccaggtctaggtggtaaaagcctcgtgaatttactttcttatttaattgtagaggaggtgcatttatctgtatgagttggcgtcttatctgtctattaatttgttgtatctctggcttccagcagccccatagtaggaactcaacaaatatttgctgaatgaatgtatctactcaagtgtatttaggaacaaacaaaaacaaccaaatcaaaaggaattatcctagctcactaccgagatagctagttctagaaagcactagcaagtagctgataattaattgaactggaactagaaacagagtctagttccttgcccaccctccccttcattttttcctgactgccacctttatcattgaatcctaaggttgcgagaggccttaccccatcagttctgcaactccctctgtgaggctcctgcttatttacctggcatgtatttaatgtctatggcatatgcactagtactaagctctgtacccctttctttacacgtcattaaatgaagaaattcacactcatcatctctaaggtttttagagagtagaaattccttattccttttatagatttccttagtacctcatttgagttcttggcacaatggaggctcttctctttttattttgtattttttttatttttagagacagggacttggtctgttgcccaggctggagtgcagtggcacaatcatagctcattgtagccttgtactcgtccgttcaagagatcctttcacttcagcctcccaagtagctaggcacatatcaccacacccaggctaattttctaatttttttttacaaacagggtctcactatattgcccaggctagtcctgaactcctgacctcaagcgatcctcccacttcagcctcccaaagcactgggattatatgcatcagccaccatgcctggccaaagcacttttaatactgttttaatgactgataccaagagcgggtcacaagccatggaaatgatgagcatcttcttaggaggataaatattttcttttcaaacaaatgcctatctttttacataaaattttgatcattaatatctagtaaacaaaatgtttgctttcttggtttctgttcatttggacaaattggatctgtgtttttttgccagctaccaggcctttctatatgctactttcttctttaaatgtttttttacaagtcagaatttataaatctgcccttttgtctggctgtatcccataatcaatcatattgtcattctgctttcatttccctttatttctgaaaatagaaggaaactgtcttttgactagagagtagatctctaaacctagcaggtaggaaaattatttaataatctggaaatcagagcagaacacgagtgctttccatggattcccagtctgtattacccagtagtttctcatgcagaagccagcttctcctggctttccttgagcccttgggttaagtcattcatccatctttcttagactcttagactaaatttactcatttaagaaactataataatgagagggattttgtttccccccaaagagagtctttggcactaagacgttattttttgtctttaggtgttaaggatttcagtcagtgtcaagaggtaagaaggataataccagagataataccagatgtaatcagacttaactttgggtgaaagtagttggtgtaggggaaagaaagtgaaaagtatttgtagagtgctgaatagcttgtaatctttcaacatgccttagatctattatctaactttctctttcttacaaaaatcctatgaagtctgtagattctgggcaattgagttctgataattcttgggtgtacagatatggagattgagtacccaataccgtattgctttgtgtttttagggaatattccatgattgaaagacagggctggttttatatccttgctttaatgcctatgctaattggctgggtaactctgggtgtgaccccttacttctccaaacctctgtttccttaagtgggaataattcctacactacagggttgttgtaagggttgagcatctaatccataatgtgcactcagtaaatacaagttagccttctttcttcatttacagtctaagaatggttttcttagaattaatgtatagcttatgaagaagaaaacctattaagaaaaaaagccagtttagtgtatcttttcttttcttttttttttagacggagttttgctcttgttgcccaggttggagtgcaatggcgcgatctcaggtcactgctacctccgcctcttgggttcaagcgagtctcctgcctcagcttcccgagtagctgggattacaggcacccgccatcacacccagctaatttttttttttttgtatttttttgtatttttagtagagatggggtttctccatgttggccaggatgatctcgaactcctgacctcaggtgatccacccacctaggccttccaaagtgcgggaatacaggcgtgagccactgcgcccagccttcagtgtatgtttcaaagaggtatactcaggatacacgcaactgtttttcatagaactttgccctaggtttgatcacctaataacatgcttgaaagacacctggtgggtttatcagtagccaattctagcaagcccatgatctaggaatattatacgtgccaaaaacagtgctgagggatagaatacttgccagagacactgcagcccagaggtttgtgagtcataaagctacatcttacatctgaatttataagtccacatagactttaaatatttcattttggaggggaagggatcaaactaaacaacgtcattattacttgaattccgagatccaggggagtaataattttattgtcattttggataatggggctttggtttttaacattacaataataggtaatcataacagtgggaactaaatgttcccataggaatcgcctaggtagggaaagtgcagaagattccttaatgtggtatacggagtaagaatcaaaaattaatgacttgactttaaagtttggaaacatcagttagttgctacccttccccgtactctccctggaggattggtgaaggagcacttataaatctcacaaggagataaagccccatggagctgtctgtgggatttatggcatgctgggaaagcttctgggctgtggggaagcctctccattcatagcaggcttcattcacagagaatattaggtcacacagaagctcactaccccctgctgacctttacagacagagattggttgggctgcacaaaaacagaatggactcaagcaagccagggcacctgttaacctgtgaccttagtttatgaagaccttggacatttgaggctctgaatgagagaaaaaggagggagctatgaattttggaagttcactctggatactaatttgtatgtgacaatttgtgatcttatttggcaaatgcaacagtgactattttaattcaaactcctctccctccgtgcaactcttaaatccttgaacttctcaaaattgcattgatgtattccttttataaagtaggtaacgaagtcattgaaactaagtttttgccctaggtccgacagtaaattggctccaaatggaaatgcaacctgttaattcataacgccttagttcagcagtccccaaccttttggcaccagggactggttttgtggaagacagtttttccatgaacgggggttgaggggtgttcgtttcaggatgaaactgtttcacctcagatcatcaggcattagttagattcccataagaagtgtacaacctaggtccctcgcatgtgcagttcacaataggcttggcgctcctatgagaatctaatgtcgccgctgatctgacaggaggtggagctcaggcagtaatgctggctcacctgccactcacctgctgctgtgaggcccggttcctaacaggccatagactgctactggtccatggtgcaggggttggagacccttgctttagttattggcattctgagtttcaagcagaaaagtatcagatgaaagtgaaattattttatttgaaaaatgtggtcggcaaacttcttaaaatccacttaatatttaaatttgctttctgggaaactttggaatccttaaaggatgaccagaatgtcagaaatggagatttgtgttagagaagatagaatctgttatggattaatgttggaccaagactccaggagtactactctttttcaggagatgagaaacacagcttcctgtttccttcaggagggttcctggactctatctaggaaaccctactgagacaggatggcaaagggggatgggatttctgtgtgataaaacactagctattgtttgttattacagctccctttacatcttcctgaggatgaaggatattcatcatagaagcctgaccacgtggcttcattctaacaagtggcttcaagcaaggtcaactcttggggctcgtgtagttttttcagagcacattggtttgtcatacacatgcccttctgcctctcctgcctccacatttctactttcttcatagttcagaggtgtaattcccttcttctatcagataaagatcatggtgacaacacaaataccttaactggaacgtacacagaaagaaaatgtctcagccagtgtgaaggtgtctcttgacactgacacaatctgagagggacttctgggcaggggtatgctgataaactggccctccaaaataaaaaccctaatttgtagcattgctaattttcatggcgtaaatagtgtcaccatgtctgaactcacactaccaacatgatgccactgaatgcagaggtgaggagtgtgcacatttggctcgtgcaagaggttcaagctggctccagcataccgctgtctaagccttgatatgtttgtataattagagggaaggtacatatgtcagcacatatgtgaatctggtggtgaagatttcttctggtttctctgcccagaaatgccatcatagatcagacgatgtatgaatttgccacatgtgcaagtgcctcttctggtgctgcccatctttactcttggaaccagcttaattttggtactcatccagataccatccttagcctactactcttcctattttaattgatgtaatttctacatatttccatcttagacccttctcccaacttttagattctaactgcctgttggacttaccattggcatgtaattcagtacctaacccaccaaaatctgacttcctcccctcaattttctttcttataggtgacaccattacctttccagccatccacactagaaatcaggtgaagtttccagattctttattttccttcattttattctctacatccaattgatcagaagtcttgatgatcttctttttgattatttgatgggagggtaaatgtgtccctcccatctgccaccttctccattcctattattgtactagttaaagcccttgcagttgcttatctggaatatccacaactttcgtactggtttttccaactttaaaactgtcctcatcaaatctgtcctccacgttgatttccttgactatgcttaaaacctcatcattggtctcccatttcaacaggacacagagtctcagctccttagcatgcaacctaagtcctccataatcaggtagtctcctgctggctctccagccaaagcattccttccctctgtcatattgtttatgcagccacacattttccccctgtagtggtggaaaggtatgatgcctttcctcacccatcataagggtcatcggtaactctcctataacaaaagacaggttaacaagagaaaagcataacagatttctttaatcaaagttttatgtgacatgggagccttcagaaataatggcccaaagagccagaggaaactttccatttttatgcttagagtcaatgaagaatggacagccatgtggaaatgtgattggatgaaacgggtatgatctaatggtaatagactaagggggaacccagcaaggcctgtctgttcagattcttcctggccactctttgtagtattcttctttccccctgggtgtgggccaggacccctatggaatgagggtcttatgatctactatcagacaaggtaggtcagagaatttatggtcagcttctaaacaaaaaggtgagggaggttagagcaatatttccaggctttaagccttgctttaggataagagggggttctagtttctatgactcaccttgggaaggaggaatcctggtttctatgattcacttcaagggagaaagaagtgtaggagacaggagggcaggaaaaggtcagagaatttgcttctgaggctgcttctgaggccttccaattcctttagttcaaagtcctcagcatgtcaaagttccatactttgggatagcgttttcatgacttttttaatgcttgtttctctgcctgctgtgccctccccaacatagttaactctcattcattatgtgaaacccagtgcaggccaggtatggtggctcatgcctgtaatgctagcactttgagaggccaaggtgggagaatcgcttgagtccaggagtttgagaccagcttgggcaatatagcgaggccttgtctctaaaaaataaataaataaataaataaataataaataaataaataaataaattagctggggtggtgcgtgcctgtagtcccagctacttgggaggctgaggtgggaggaatgcttgagcatgggaggttgaggctgcattgaaccctgattgcaccactgtactgcggcctgggcaatagagatggactgcatctctaacaaacaaacaaaacaaaacaacccagtgcagacagaacctacttaagaagccttttctgacacctcctttacactgggcccctcttggtgcttccctccatgtcttgcctctctctccaccattttactcacattttattgtaatggtttctttgtgtctgtttccttcaccagactgaacaacttggttgccagaactgcatgctatttacctttatatgtctagtaccttgcacagtgcctggcacatagtaccatttagttaatatgtagctgaataagtagatgaataaatggaaaagacagccattgtgtatgtgctagtagcataaaaatacaggatacacaattacatttcaaattcagataaataacaaataggtttttttagtatgcatagatcccaaacatggaatgggacatacttataccacatagtatgtaattattcattatttctctgaaattaaaatttcactgggcatcctgtaatttatctgtcaaccctaacctagcaaaaaagtgacttcccacccaatattaggttagcacaaaggtgattgtgacaagttttggtttaagttttgttaagtttgccactatttttaatggcaaaagccataatcacctttgcaccaacctaataaaagttcacacaaggcagaacctcatgttgagcttgacatcatgggccctaaagtattttctagactttaccttaacatctctgagtgtcctgtgtgtaaatagtcactgtagtactcaggtgtattggccttgtcatgttctgctgggtgtcattacatacatgatttctgctgagagaatgatgcaaattttgttgcatggcaaagaaatttatgcagttgagtaatatggagagatgagcagagcttatttgtgagtcagcttgtgggttttcctatacaggtggagtatccttaatcttaaaaccgaaattcaaagtgctccaacatccatgcttattgcagtgttttgcagtttggattttcagaatggggatacttgaatggtaagtatagtgggaatatttcaaaatctgaaaaattctgaaatccaaaccactttcagtcccaagaatttgagataaaagatcctcagcctgtattgtggtggtttgttgttgctggatagtggttgtagggcatatgaaaaggaagcataaaacttacttttggtgtttggggatgaatgtagggattgggtgtgggttttagatttttggagggagttaacagctggaatagtactcactatttactttgctgctcaggccaagatgcctgagaactgatatactgaagagtgatcatggtgtggaggactccatactgtctccatcctaatgaggttgtttgcttaacacgttccctgttaaactatcagatgactgaattattattttgattgaagggactttttttttttttcaaattagaaacacccaactggttaacagtttatgttttagaaggtgaaagagtttatttttccatgactggaaacggaattgaaatatggcatctttcatctctcacatgccctttttcctctccgtctcatgccaaaatcgataattatggaaattacctggtaggacacttgggcacagttttagatatttaccccataggactcagacatgttctcttagaaaaagctggattctaaaggcacaaagatcaaccaaaaaaacaaacatgaaacatttttgtggtcacagtaccgtgatcttgtcagtaaagcgacggtctatgattaaatccagattgagctgtttcctgttagcgtgctaacccacaggacaggctcaggcctccgtgtcttgctttctaagtctgggttattaagcacttgtctgacaagggttccacccctttcgtcttcaacttaataattcaaagttactaagataatataagcaaaaacaggtcctaaagtctcttaaaacacttacagacctataggaatcttttcttgcaaaaatgaaacttttaacattttagcttctcttgtcgggccatatggcagagtattttttgtgtttcccctctgtacagtttcatttcaaaataatttcagtggtaagcagatcattttaagtttttgtttcataagaaatgtactctatttgaatgttggcaaattagaagtcatcagatctttcccctgccataataagcaggtattaggatatttagcagttctacagaaaatgacattaagcaaattctctgataacttaacatgcattgttattttgtgtgagaatgattgtaggcacaagagcaattctatacttattttatgatattgtcattgatgttcactttgaaaattattttttaaatctaaattttcaaaatattttattagtcttctgttaggtcatatgtggttcttcctaatgcacagatgcaaaccctgaggaacaaatactgttaaagggacttacaggaatcatgtatgcatattgaaattttttccgagtaagaaagtactgaaagagaggggctgggttaatgagaaacataattccattcccaagggagaaccctggctttctgccaaatctctgctttctggcaggaaatgggacccacttcatcaggtcctttgacaagcatttttctctgtgtttgaattttgggacacgtcaatactcggtgaaaaaatagttcttttaaataatcatcacttttgataagaaggatttagaattaaagtagagtttccattgtaagtaaaataagaatcgtcaaatttcaacattgtttggtaagggaacactgttattatcacaaggcgaggaagcttgatttaaatcagagtttgactatccctaaccactgagaagccattccttttattgttgttaatatttaacattgaagtatattttcatgtttttttttgtttgtttgcttttgagatggagtctcgctctgttgcccaggctggagtgcagtggcacaatctccagcccactgcaacctccgcttcctgggttcaagtgattctcctgcctcagcttcctgagtagctgagactacaggcacgcacattacacgtggctgattttgtatttttagtagagatggggttttactatgttggccaggctgttcttgaactcctgacctcaggtgatccaccccccttggcctcccgaagtgctgggattacaggcgtgagccaccgctcccatcctgaagtatattttctaactgctacttttgaatatcatgcaggctgacaattattttggccaggtcttttgaagtgacaaggtacaaaacacaaaacatcctgacatttttgtattaataaagagatcaaaggaatacacatttgaaaataaaaattaacattatattttataatgttttgatttttcttttttaaatgaaaagtggtaaatatgagttaagttttaaatgcattacagtaatttaataagccaaaatttttcaaagtatgtgcattctgaagttctgcaagatgctctcagactaaagagaaatccatctggaaatgctgcataccatacccctctcttggagttgaataacaccgttggcatatgagaaattctgcagtaaagagatatcattgactttgttgaactctatagttcccaaacttgaccataggagttttttttggaactagtgttttacggcacacacttcaagcaacagtgaaccaaataattaataacatgtagaattctaaaccatatatctttttcacttattgtttctgataaagttaattggaacttctggggaacagatgggtactacaaggtttgttctaaaactacatatagagtgataaagaacagctattagaccctgatctgagtcaacagtcttaagaggcctaaagaaatgtttgctattttgcctgaaccagatccctctccctagaaaactttcagaaattaaataaagagataaagccatctaccacataagctggagtcttaattttaattcctgttagcggtttgacatgatgacattaagctattctaacccccttctgaaagcagttgccaccactctggtctttctgaaagcaatccatctgttagtttccttccagtagtttgatttctgacaggccaggtgaaggaaaagcaaacatgctacttagtaagcacaatatcatcattagagatccacttctttcttctttgtgtctcttctttaattttcacatgtgactatttcaatttaggaaatctgacataaaacaattacaattcaacttgcgattcagataaaccgcctggcgattgttcgcatcacttaggattatttttgctttagaaatagacctcctctctttagagcagtttccttagtgcctatgaaggatgagttaaactttcaaaattgcatctctgtataatttgttaggcacagatttactgcagaatgtaaggcacaccaatatttttcttcattttaattctcttcccttatactcaaattttaagctgtgaagattttattaccaatgaatttttatgtattatggtttatatctaccaaggtacaattatatctaccaatattcatttacagtttcattttcatgtgctagctgcttctcgtgagtaaatgtcttcttttagactttgcaagtttccagaaggcagggtcatacacccacccacccttttcatcactccccagagcttaacccagtggtgcttggtacaaccattttctcagtcagctctgttgattgctgatgatattgaatcaaaatgcacattgccgtctgtggactgaagaaagtcagatcatgattccatctccatagatttccacggagaatatactccaaccatggccagtttttcaagctatcaacatgatttcaactggctcacacaaattcttaaaatttaacaatcctctctccaaaaccagtatgactcagctccagcactccaccataggagctgtctttaggaatgagtgtgcaaaaatttttttcccattctctaggttgcctgttcactcatagttcaaccattgtggaagacagtgtggcgattcctcaaggatctagaaccagaaacaccctttgtcccaacaatcccattactgggtatatacccaaaggattataaatcattctactataaagacacatgcacacgtgtgtttattgcagcactgttcacaatagcaaagacttggaaccaacccaaatgcccatcagtgatagactggataaagaaaatgaggcacatatacaccatggaatactgtgcagccataaaaaaggatgagttcatgtcctttggagggacatggatgaagctggaaaccatcattctcagcaaactaacagaagaacagaaaaccaaacaccgcatgttctcactcataagtgggagttgaacaatgaggacatatggacacagagaggggaacgtcacacatgggggcctgtcgggggtggggtgacagactaggggagggatagccttaggagaaatacctaatatagatgatgggttgatgggtgcaacaaaccaccatggcatgtgtatacctatgtaacaaacctgcatatgtatcccagcacttaaagtataatttttaaaaaaaaaaagaataaaaaactccaacaacaacaacaacaaaaaagaatgagtttgtccaggtgcagtggctcacgcctgtaatcacaacacttttggaggctgaggcgggcgtatcacctgaggtcaggagttcaagaccagcctggccaacatggtgaaaacctgtctctcctaaaaatgcaaaaattagtcgggtgtggtgatgggtgcctgtaatcccagctactcgggaggctgaggcaggagaattacttgaccccaggaggtggaggttgcagtgagccaagatcacatcactgcactccagcctgggcgacaaagcgagactccatctcaaaaaaaagaatgagtttgaaaactttccatggaacaaaacaaagggaatgcttgctaaacctgatcctggtatcattaaaaatgcgcttggtaaaattatatcagcaaactagttcttgataggggagtaagtagaagcaaatgtaaccattatgaagtaatacctctacttctagaaaggtaggaaacacgcatacctccaccaccaccaccctaccacactaaactcataggagagagcattgccttatatgacatgtagagaaattaaataagagtgagggtaagctgcatgcagtggctcacacctataatcccagcattttgggaggccaaggcgagagggttgcttgaacccaggagtttgagaccagtctggataacatagcgagacactatctctaccaaaaacaaaaatacaaaaatgagcagagcatggttgcctgagcctgtagtcccagctacttgggaggctgagtcaggaggatcactcgagcccaggagctccaagctgcagtgatctgtgatcacaccactgctctccagcctgggtaacaaaagggataaataaataaataagaatgagaggaaacataacaggctatggccttcaactatttcaatgcttccaattttactttagggagtcatttctccttatggtaattgttaatttattatacaggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtaagaatgtaaaggagcttttgagttgaaagaaatgtaggctgattatggagtggagcacgaggttctgaatcacctgcacttggtattcggagagagatatgtgaggaaagattaacgggaagggatgacctttggcacaaatgaaaagaagatcattcaggagccacttatggtctgttgctggggaaaaatatctcctaaaagatttataaaagagttgagagtggataccttaaatctagattcagttgctttatggatttactatttgccaccctaaatttctccatatttttataattttatattattcagtaaataatcagttgaccaagaattttactgggatgttgtggggatgaaatgtgctaatatgtgtgaagtgtggagctcattcttagatccacaggaagcagcttaggaatggtggcaatgatgatgcgatgatgatgataactattaacagtcagcatgtattgactgttttaaggatctgcacataaatatccttgatccgtatttttaagctacttattacatagagcagtatacattgatatttacacactgttaaactttagattttcctctttatttctgttttatttagaattaaacttggtcttttagaaaatatcattaaatcaacttgatactgggaggaagaaagctgtcagccaaacaattgttttagaatcaggagaatcctcatctaaatccttatattctggggtttcctgcataaggaaggaaatgagatacggctttctgttgggcttgttgagtattgatgtttgttaactaaatttttttattttgaaagtaatctgtgctcatgctaaaaattcttacactgtggaagaatatgcaaaatattaaagtttgttcatattgctgccttttccccaaataacatttattagatttaaaaatattagtagtaagaagaaaattaaatagaccatcaactaggcaaataacacatattaacattttaaaaatagaggtaatccatgtatatggtgaaaagttccatcagcccagataattataaaaataaaaagtaaaatatttttttctccaagctccaatcccattcctcccaggaaatcactgtgaaccatccttttgtatttttcccacacttttgggtgtatagaaagtatgtatgtatatatacacacatttatgtactgtatgtcatatatatgatatgtttatatatttatcatatgacacatatacttacctatgatacagatagcatcacagtacatagtctgttctgcaattttcatttaaaaaattttttttttctatttttagagataggatcttgtcctgttgtccagactggactggagtgcagtcacacaatcatagctcactgcatcctcaaactccggggctcaagagatcagcctcagcctcctgagttgctaggatgacaggtgcatgccaccacgcctggccagttttcagtttttacttatctgcatatcttggaaattttttactcattaagtgaattagtatatataaaaggcttagaacagtggctggcatattgaaagctcaaaaaatgtaattcttatttcaaaaccagcacgtgtagatgaatctatcataatcttttcaatagctttataatatttattgaatgggttattatatggatagacatttaagttttctccagtttttagtttttttttttttttttttttttgttgagatggcatctcgctctgtctccaggctggagtgcagtggcgtgatctcggctcactgcaacctccgcctcttgggttcaagcaattctcctgcctcagcctcctgggtagctgggattacaggtgcatgccaccacacccagctaatttttgtattttttgtaaagacagggctttaccatgttggccaggatgatctcgatctcttgacctcatgatctgccgcctcagcctcccaaagtgctgggattagacttgagagccgctgcgcccagcaaatttgttttttaaactttgtaaacagtactgcaaggagcatttttgaatatatatcttcggaatagttggttgagaattctataggataatgtcatagaagagtcactaatgggtcaaagtatatcagcatttaaagatttgaaagataactgccagattgcaccagtgacattcctgtccacagaaaacgggaatgcctatttcctcattttccccacactcttgccaactgtggatattttctctctacttttgaaactgtctttgccatgacctgaccactgacaaatgatagcttcttgtttttgaatttgtgcttcttacatttatgagtgaggtttagcatcttttaaaattcttattggctgtttgtgttttcttttctgtgaactgccttttcatatccttttgcctatttttcttttggactcttttcatctaattattgattatctaattataactctgcatattaagggaattagtttgttgcttatcatatgttagaaatattttcctaatttttccattcgttttaaaagttatttattaaaattttttataacgacattaacattttttgtgtagtcatatctattagtcttaagaaatacctttaataatcaagttatattccaatataagtaaggttattgacaatagtgggttttctctcaaagtagtttactcgtaagatgcatatagagtaagattatttggatcaatggttattaatatgttaatcttcaagaatactcacaaaatgtctgttctttgtcatacattgatctggattatgatactttgagctgcagcacagataggaagttctgtagcttttttcatagcagtgcttgacaaaataggcctggaatataaacttggattggtgaggcatttctttatataggcaggatcttatgtaatagatcatacctgtaagtagaaattgaaaaattatatgaattttatctttttggtatttcatgtttataaaaaaatgcagtatgctgttggcaggcagtatgaattgactgttcaaaacgttaaaaaactcctacaagtttactttggaattggtaacctcttctatttatggggtgactattgataataggccacagatatccacagtcaataaaggagtgcacgtaaattccagctgttcatcctaaatagaggacatatacacacaggaactggagtgtttagtctatgactcatgtacatccagattttgatattttttaaatcttttctttgttctattatagaggatagatgtttttgctttttaaaacactaactggatgactgactaacactgaaaatgaatcaaactgcatttaattcaagctgtcatgtacgatataactggagagttaggatttatttttttaccatttggatgggccaaggcttggccttgaatttaatctcataaacagatcctttgcttgcttctgaaatgaatggaattgacaagtactcaatgcctacacaatacccagcttctgcaagacaccatgcagatggaactcaggaatatgagacttgtttcatgccttgagatagtttagaggtagatttactatgaagccactggtacttaacctccaggggcgctcacttggaatgccctctgcataattttatattcatgattttgtattctttttctttgagaggatccctcagattacatatggcttcaaattacatatccataagacctggatccacccctcagtacttaatattttactgcaaaagataacatattaaggcttgcatttctgaaacaagtagataactgcttgagatggtattagatgaagttctaacatgttctgcagatgaaacaggatatagaagttcagaggaataaatatcatttatttagattattctgcagaaattgggatttgttcaaataagtacaaacctcaacatgagtatttcttccttgcttcatttcctactcacacttagatcttgagccaggcttcagtcttgattaaatttaaccaaaatgcacattctgtgaaacagtgggttcttaaattggttgttgagacttttaatgtctataattaagaggaagcaattatgttgtataaacttgcctattctgaagatgagcatttgaaatattattttgtcagtagattgtggtagacttgtttatgggtctctgacataattttaaaaataatttcttttggtttcttaatagtagtttgcttatctgttgtgaaattaacactgagacgctattacagcatgtgctaatcatacaataatcagtcaagaatagattgaagacagatactgcagtatttatttcccaccggagaagcttatttgatgtcaagctttgatttcccttaagacttctaataatgtgggttttctcatatggaactatttgctttctgggatttattttttatcttttgacagttttttattctgctataatatgagccttttgtgattggccaatagacagtggtttgaattcacgtatagctaattccatgtgtttgctttaccccttacttggggtgatcatttcccaaggacccctgtttcctgtgcttctcaacatggctcagagtccacattggcctacttttaacccaagagaaagttcttgaattctgggccagcagtttgtgttggggctttgagattttcttttatctaacttcaaacatacactcactcagttaaaaatctggccaggcgtggtggctcacatctttaatcccagcactttgggaggctgaggcaggtggatcacctgaggtcaggagtttgagaccaacctggccaacatggtgaaaccctgtccctactaaaaatataaaaattagctggtatggtggcaggcgtctgtagtcctagctactcgggaggctgaggcgggagaatcgcttgaacctgggaggcagaagttgcagtgagctgaaattgcaccagcctgggcgacacagtaagacttggtctcaaaaaaaatcatctgttctctccaccataccattttaaacataagggtgttagatactactgaatatgcccaacctcaaatgtagggagaaacctactttaattagtgaccttcagtgagagccatgaaatgttggcacaagtatctagagttttcttcagatagctgtcacaatagctcccttttgggccatttcttgaacattctctctttctgtgttatgcactctaatatcagaattaagcagaatgagctgagtgcagtggctcatgcttgtaatcccagcactttgggaggccgaggtgggcggttcacttgaggccaggagtttgagaccagcctggccaacaaggcaaaaccccatctctactaaaaatacaaaagttagctgggcgtggtggtgcatgcctgtagccctagggagggtgaggcaggaggataacttgagcctgggaagcggaggttgcagtgagctgagattgtgccactgcaatccagcctgggtaacaaagcgagaccctgtctaaaagaaaaaaaaagtaagcagaatgccaacaagaaccagagtaggggttaactaggtctccagaaacctttgccaagctgatggcactcaggtcacactatggaaagcactgagtaatagtctgaattactcccttaatttcaaatgaattctcccagtggaggacattcggggtttttaaaggttggagccatttgtaaacactatgctttaagattatctgacttaaatttgcttgcttatggtgcagagaagagactaattcagtaggtctttgaacttatttcttcttcccatgtttgcttgccatgtgttttcacaggcttcatctcatttagttcacttatttttacccctatgtttacagattagaaaattgtggctcagaaacattcaatcagtaagtagcagagctagaattaaaacctactcctttctgacttggaagctctttccaagtgtacaatatcaccttccttgatttgttaatatcacctttaaaggaacccttttttgggaatcctttttagccatccttttcactactacctcaagtgattttccctggaaactgtatttcccaagggctcctcccttcacacagttgtgagcagttcacttgagcatcagtgctgttatttgtctactcaagcaatatttatcagctctttaatgtgtactatgtactgtacaagatgctgtgtgtataatggtggacaaacctgccttcttcatgctgaatgtctagtgggaaagagtaacattaaacaaatcagtgtgcaaatacatttatataattaaaattgatagaccactgggagataaaaggttctataacacagagttataaaggatattttggagagctgtacccaaataaaactgaatgttggccaggatcttaggtgatcacttagatcatggcccataaaggtaattgctttgtctgtgtgtttggagtgtttctgtgtactgaatgggcctggccaaatccctgacctcgatcagcttttcctgaagggtcagggatagcaaatgagagagcacgggtggatttaagtaagtatagtaccaccgtgggaacagaaaccttaaatccattctttatgtcgcctggagtaacattttcatatgcaaaacctgacataccaataaccagcaaaacggagctgcctttgttagtgcaaccagttcctccacagtgtagagaggagttgatcagatataaagcttgaaaattttcatttatttccaaggattttgtcatagatgtcaaacagacttttcagaattttaggatacattatgggaaaagcaatttttcctgtctttttttttacccatgagattcagatttaaggcatatagtataatggttaagaacatgggcttaggagtcagaaatttgaattttattccagttttgcactccttacttgctctgcagtattgggcagtgaatttatcttactagcttcagttttcctcatctataaaataacaaaaatagcacctaatttatagagttattataaagtttgaacatgataatataggtaaaatttgtagtatagtggctgaaaaatattaagtgcttaagagattactattaccttgttttctttcttcaaggcatttattattatttgaaattaccttatttatcttgcttatttcatgactgtctttcccactcagagaccatgttagtcttgttcattgctctaccctcaaaatggtgcctgcagtaggtgcttaggaactatttgtctaacaaataaataatggttatcattattcatgccttttccaagcaggtgttttggaaggtccagcagtgaacattgcccagcctctgcccatgtttagtgggagagacaaataagtctatagactcgtgtcatcactgtcaaggccatgaggctgaatgtgcgtttttaatgaaaaccttttccccccgggagctggtagttgtaaaccttctataaaaagcccattgcacacatccattcagttctcaaatgctttcgttgcatgagaagctggtaagtgtttttgagatgcgtacaatatgttccaatttgctttttgttaaacctcacttaaaaataattgaattttttatttagtgctggaattacactaggcacttgccaaatattcctagattcatgctggcatgcagtgttcatgttcctgtacttccttttctttcagtaagaggcaaggtttctaatatctttcctctcctcttccaggtccaaggaaaggaagttgtcaacagagagagcactgggaaacatactggaaactgaacccgcacgacgggtctcagagcatcttcatgtgacttatggtcccagtgtcgcctctagggtcaccagcatctagaggtgacactgagaccataactcacctgtaggtgctggtctcttatagcattaacactcacattaaatcttgttactatgaaactcataatttgatttttttctaaactttttgttctgagttatttattaatgtttaacttccatcacttacataggaaatttttcaaaataattccataccattctcttcattaattttagtaacctcctacagggccaaatcgaaattagcagagagggtcactcattaagtcttttgtgcctcccccaacccacccatgcatgaaacagttgagatttagtggttggtggctccaggatgcacatcccatttatttagtagaaaaactttcaggaaatcttaacattgctttgcttcctttctagcttaacatacaatcatattgaatatcctgactagggtgagaatttcttagtaaatgaaggctgctatttaagatttttgttagaacagatgagtttaaatagattttctctaggtctgggtgttgatgacttcctaggcaaaaaaacccaaaaaaacttggatgggttacacacacatacacatacacacacatatatataacagaacatatatatatatgttctgttatgtatatgaccctctctactagtttccatttggctctgtggggggttactaaaattaatgaagagaatatggaattattttgaaaaatttcctatataagtgatagaagttaaacattaataaataactcttagaacaaacaaaaagtttagaaaaatgtcaaattatgagtttatgttctattcaggacatcatgccctgttcagttttggtccacacactcagctccaggaagcatggctggagccagaatgtgaccagaattgttattattttctccctgtaaatatatatatatttttatatatatatatatgttaaggtgttttttaaaaaaaggtagattgctgaaagataaattggacttagatcttatttcctgcaactatgagaaacatgacactattggttggtagaagagaaaagaggattgtaagaagggtgtgaaaatctttgggtatgaaaatggttataatatagaaaagagcattaaaaactttgataggggatgcctttcataaaaggtctcaggctcttgctggctcacactttatcaggtggagagaaacagtttagctcagaaaacaatagaaggtataacatttataataatttacatatccaaagatgtccacatcctcatccctgaaacctgggaatatgttaggttatatgcaaaggggaattgaggttgcagatggaattaaggttactaatcagctgactataaaataaggagattatcttggattatctgagtgagcccagagtaatcacaagggtccttaaaaatgtaaaagatggaggcagaagacagagaaagagatacaaggatggaaatgggatcagatagatgctatgttgctggctttgaagatggaggaagggggccttgagccaaagaatgcaggcagcctcttgaagctagaaaaggggattgaacagattctcttctagaacctctagaaaggaacatagccctgacaacaccttgattttaacccattgagacccttgttggacttctgacttacagaactataaaatagtaaatttgtattgttataagccactaagtttgtaataatttattccagcaacacagataagaaacaaggaattcttgtcagggagattgactctgaaaaatctagtggccataggctcaaggatgttgaaggtcggtgtccaccctcacctttgttctgttcaggacatcatgccctgttcagtttcggtccacacactcagctccaggaagcatggccggagccagaatgtgatgggcattgttattattttctccctgtaactatgccagttactttggattaaccagaaaaatttaatctggtgctgtttgagaattatatccaaccataattacctgagggaaaatggaaataagttctcttccctgctgggttggtggcctttggtaaatatttacttttgccaagtggacccaactgtcacctgccaacactatgggaattctggataggaacatgtggcgactgtagagccttagcttgtgggacgacagtgatggttttgttaaagtagacactgaggggatgctgtcaaagactttgcctcagatcatagccaggctagctttcttttcttgaaatgggatttataagacctaagagataaaaatgtttccatgaagtagcttgttttttttatttcacttggcaaagggaggcaaggacatgcaattatcctttttttgaaaagaatataaaattgcccagcaggttttttttttaaagtgtgcttaacatttgtaaactacaaaacaaaactgacaagaaactgaaatgtaatgggtggtaactgagttagtaactggacagtcagacattcagctttgatcatttaaagcagtggttttgaccatttttcagcagttggtgggagtgattgatcacaaacccctgtaagaatgtactaaaaactatggaccttctctttagaaaaaagagaatgtcacaatttttttcataaaatttagggacttcccagacttctgtaaattcatctagagaccctgggttatgatcccctaggcaaagtgtccctagcgtggtaacaggggatatgtaggcagccattatgaatgagaggtgggcactgatcctagctttattataactggaacacagaccttaagtgtggctctgaaaagtaaaccaatcaaattaactaaaattacgcttcatggttcattcaggtaaatttaatggttttagaaagtatcttgggacatctaaaaggggaagatactggtggttttgagttaattttgtttttcatatcgctattctcttatctgaaaattttttttacatttattttttgtgaacttagcccttgataatgctgtcaggcccctagtcctgggaacacaattcttttgcctttggcctctactaaagctaacagtaagcacccatttagataaattgatattccgttgagtttttgtaagctataggcgaaaaagaaaagtattcttgaaaatgaaaggatgccatgatactaaactcatattcattgtatttgatgttacaaagcatgtttcataagattttgaagagctctgcaatagcagctttttgtggttggggaaaactgagccacaggcttgtactgatttgttaataatgtattaattcatcttaaacctgagaaaaatctagactcatgaacagagtctgagtgctgcctccttcctacccccatctaccagtttcttctgttgtccgtcattgtagcctcatccattgcagtgtactaacaagatgtgtttgcagttggtggtttagcattgttatgaactagaagtggaaggagtagctacggatgggccaccaagctctgagtgcaggaaacaggccagagaaaagaaacggatgacagaggcttggaatggaaaatagaagaaaccttatagcaggagtgtgagagccaacatacttaaataattttaaatctgcgtgagatataagttgtggcaggagagaactttttttctttcccttggatgaatagtgtccttttcttgaactcctctttagacagttgtgggttaagggctggaaagaaaggttattctccaggaaaatgttatagcattttgtaactgtcaagtggggcagaaatatcaggtactcttttgctgttaatgttgccttaagtgtcagggacttagtatggagatatgtggacaatgaaagaacaaggaaggtgcagtgtccttcacagcaaaggcctagaggtgaggagggcagcttttgttgggtcttctagctttttctagtcagggaaaaatggcctagagaactaaccctcataaatggaaagcacagtatagggttctcggctcaatcttcttggccccttcctttcctgcaagagaacaaggagtttttgccttgttgtttttgacctttgtctttccccttgaataagtaacttcacagtggtaacaagacctttccaaggtaggcttggtggctgtgacccagttctcaggtcagacttggcggagaggtgcctgccatggaggatattattcagagtaattaaaaccacacttcttgctgatctgtggaaacagtccaaagtcttcactaaggttttcaccagacatctgcaggctatttcacccatgtcgttctcctgagtcaaggtcagcttctgaacatttttttcatacctgacctgtgttcttttgggtcagttacagaaaaatgcctaagatgttctgaggccagcatttattagaaaagattcccaggagtccttgagtcagcagcttcatgtgaggtctctctttcctttacttcttcctttccgttctttcactatccccaataaagtacctccttcccaactcttcccgccccagcctttcttttattcttggtagaagagggtgtgtattaattcattgagcaaatatttattgtctactttgtgcaggctctattccaggctcagtagaagtagcagtaagcaaaatagaagagtaaaaccagagtccttgccacagcctacctaccaggccctcagcatctgtccttgtcatctccatgcctccttttctattcacgctcactcagctctgcccctcattggcctcttaatgtttcttagaaacatccttctgctactcttccaaggcctttgcattggctctttggactgcttagaggctctttccctggagatctgcagggcccacttcctcactttctggagagtttacttagttttcacattcacattgggccttccccaaatacccaacctctggccctccattataccaggtcaccctgacctgctttatttctctccattgcacttttcactctctgacttagtatatattaactaattattgttgtctgtctcctccgcactaccatgtatacttcatgaaaacagagactttggtttgtttgctgctgtatcctcaatgtctagaatagtacctgtacgtagtccttagtaaataatcctcattgaatgaggactaaatgagtgaaagaatgaatgatggaataaatgaatgaaaggctcaccatagcttgtatggtagggagtgattcagaggctggttgctgaacgctgactgtcatggctgaaatccctgctgcacgtattagttgtatctttgagggcatgttacttaatttaagccttctgggcctcatttttctcatctgtagaataggaataaaaataacttcactctatagaattataggagaactaaaccaagccagcatgtaaagcccttagcacagtacctggcatatagtaagttctcaataattattaactgctgttattattggatcatttgccagaatcaagcagagcctgagagattcttcaggatcacccgcctcctgatctggtgttactgagactttcctgttggggagcaaaggttagcaagggcccccactagagagaccgtccctgggtacaactttatctaagggtttctttgaaccacagatacacctggtcttccccttcaaacacatataaaacacttcaccttaccagataggctacaaagaatacagacatcctctctggaaataactgtttctgtttaaatatttagcaaccagttaaacattgtactggttttttctttcccttttctattactttttaggctgcagtaaataattgcttaaggctgcactttaggagacatttgtaaatttttcttttgccttgtgataacagagaaaaccatgtcaaaagtcattctgacaatttttattttaagttttatgagttaccatttaaagaagagcagttggtcattggtaagccttcttaagaggttggagctttgatcttaaatcctagggaggctttgcagaaattggacacgacatcgttgacaggtttgttggtagctattctatggccattaattaaacatacacactcatacacacactttatttactaccctggaataagtgaattgaacttgactttgagttttgatgggaagctatgagagggtccaggaaaacatcaaaggaaccttcttaatctagtagtactgactgtcaaaggacctagcctgaacatttaaagagttctggattccaacactagtctagtttcttttctgtaaagcagtaattctccttaatgataagaaaggtgcagggatggcctggcatgttggcttatgcctgtaatcccagcactttgaggggctaagacgggaggatcacttgagcccagaagttcgagaccggcctgggcaacagagtgagatctcgtctctacaaaaaataaaaaaaattagccaggcatggtggcatgcatctgtggtcccagctagtgcctgtggtcccagcctctcaggaggctgaggtgggaggcttgctcaaacctagaaggacaaggctacagtgagccatgactgtgccactgcattccagtctgggcaagagagtgagaccctgtttcaatgggaaaagaaaaaaaattaagaaaggtgcaggggcaaataatcatctccatcccagtccattaagttccacaaggttacaggctctttccttttatctcacttctaaaagacttctttggaatagcgtgtatacttttgttttgcattttaatagtttttacctttaagatctcaactttaacatcttaaaactttttttctttttaattgtagatttttggaataatcacagctatcttaaaacttttatgctcctaagcccttagaagtgagggcttgatacttgtagaagcataaataaggccagatgatgcctttgcagaggcaaatctgaacctagtagttgggaggtccattactgcgtctgcttctgaaaccccaatagagcactagcaacaggtagctattgcatgcctgttgggtgccaggcactaaagagttgggtgccagctctaaagagtagtgagcaaaaagaaaacatcctggtatgctggagtttattttctaatggacaattaacacaacaacaaaatgaactacacagtatatcagaaggtattaaaagccatagagaaaaataaaggagggaaggggctgatgttacagttggtttgtattttaaatagggcagtctgggaaggcctcactgataaagtgatacctgagcaaagacctgaggagctgagagagtgagcccttggcacaggtgtgggaggaggcagcagcaggcacagattcagaggcaggaggatgcccagtgtgtgggtggagcagggaggaggctggtgaggctggaaagggagtaagggctgaggaattgtaggaggcgtgggaggaggtctctgcagatcattcagggccttgtgagacacgtaagactttcgccttttctcagagtgagatgggagtcatgggagggtttctccctttttcttttttcttcttcttcttcttcctttttttgttttttgttttttgtttttgagagacagcgtcttgctatgtgttgcccaggctaggcttgaactcctgggctcaggagatcctcttgctgcagcctcttgagtagctgggattgcagacatgtgccaccatgcttggctttttatgggagggttttgagtggagcagtgacatgatctgatctacctaaagcagaattgctctggctactgggcagaagctggggaccatttaggtggctgttgtattgatttaggttacacttgatttacactatccaagatagtgtagttggagccagggtggaagcaatggaagtgatgagaagtgtttggattcaggatatattagaagggcagagcaaaaaggatttcctgatgggttgggtggagaagagttagtatgtctgcaagatttgagcctcagcaactggatcgtgtgctctgccacacactcctttttatccatggcccttattggtgtccaagttattatcaagcagtcactctgatcccaattgagaaactgtagacactctggtagccaggagaaatacttctgtggtcttctgagccattgctcagaagatgctaccaggttagttaatgagagagaacttggctcaccagtataagttacttagtctttcttgacaccttctcattacacatttggcatcacattctggggaggaactgtgatagatgttggtgccatccaaacctgcacctcagctctgagtctgaagaatgcaggaaaagagcagaagagtaggaggagctaaagcaaagataaagaatagagagatctggaaacttgtagtacaaaccactttgaaaaaaagactatcaggagcagtaaaatgtgtatctttccctggtgttttccctttttatatctacctttcatagcttccagttgaaagataaaaagatgtgatatttccacaataactggagtgggaattaatggactaacatggaatgtaacaaaaacaaagattaagtcccacatttagtaattgagagatggcaagagaagagtttatggatccttctagtcagatacatagaagatacactggctttccaagatcccactcttgcttgcacccaccgtaatctctcctacttaaataaaccaccaagcctgctgtgagagagtacgaggacatagtttgctacgatgttggccaagtatagagctgaaaaatctcaccctgtttatttattaggaatcttgttttccatccttgccttgctcatgtggggctgagtaaatcttaatctgagttcttatctcaggaagagcaaagggtagccctggaagccttctaaatagcaggtgcaggacagaatgaagaggaaaagagagggtggagaccagtggaaaatatctttgagaggccaagaaatccataaggctgatgagctagagaaaggagcaggtggatgggtgagctggtgcctaagggcgcaaactggaacctaccgggatgggatgatagggacaccagatggactggcgttgggtcaaaccagatggtgggcttttatttttaaaaggatttgtaagtcctaggaacaaggaaccataagggtactgggcctttaatcccattagtagaaaacaaaagtgtgctctttaaaaatgtaaactcatcaattatagaatttatcaaaactttgggacagactactcacttgtgaaaccccaaggaatctctggattctgtattgatggaaggagaaactgaagaaatagtctaggcattataagttaattaaagactcctccttaataatttaaagtgcgtttactaagtttacattccaaaccaaacaaaatatgatatatttgtatgaaataggctggctcacatgtggagttgggagaacagctagcagtgtaagtagggactgatgaattattgagtaaattttgagttggtaatgagaaaatttttaaaatttaagcatctattgctttcccaaaaatcagacccctgcaccccacctccccagttgctgtgtctagcgcaacctggcctcagtatagctacagctgctctcatggttgctaagacatgagagcttctactgtagtccttgtctctatcccagccttaattttagggtccagagctatttccataatccctctacaacggacttattttcaaggagaccagactcttaagtgtagcctggagccatcagtttgtgctcccatgtggcatgagtgtggatgctgtgcctgcagagccatgtgtcccttgcatagacatgcagaggggttggacgggagggtttggtgtgctacagagttcatgaggaatctgccttcttcgtattatgtaatagccgattctcctgctgataggaacactctaatctaaaaaagtcaataaatgttaagtgttaatattaagagaaagttttaagtagtgtgattagttgttaaatgacttttctgtttagaatatgcagatatatccattaagtaactatcaataatactgcatcattttcaatgctatttcatagatatatctttccttaattacttctgaaaagtataactgtcactttgtagttgaagttgaatagagttgctttccaacaccactgactgtttttgcttgcttgttcattattatctctacaggtatggaaacctgacaagcccaaactgtgaagaagatggaagccaaagttcatcagagtccaaaatggtgatcaggaagtgagtctcccttttctttgcattctaagctctcagtcaagacaatatcttaaagtagtttagtagagtattttattcctttgaatgttgccatgatttttttttccatagtgcatacagaggcttattttttgattacctaacaatattcatttatgtatccagtgaaagtatcttaagtaaccactgtctgccaggcattgtgctaaggtatacaaaacaaacaagtgaagaaaacaaacgaacaaaataaacagtcccagctcataaaaagtgtgtattttaccagaaagagacaaagaatacacacaaaaaagtgaagaagaatgaagcagggtctgagggctggagcgtttggctatgtgtagggtgcccggattgggctgtctggtctgttggcattggagcacgccgaaatgaggtgtgccctgagccttgcaaatagccaggccgacagaccacgggaaagcctctgaggcaggagcggtgtttgagaatcagcagggaattgcatgtggccggagcgcgtgctaggggatgagcactgtgaggtgagcaggaaggtggccactcacaaggggactcatagcaacttggggaaagatgttgaatttgattctgaggaagataagaagcgcttagaaggttttgagaagagtgctgtggcctgacacatcttaaaagacccgctctggctctgtgtccggaaagtagcctgtggcagtgtggctggggacaagggtgggagcagggagcctggtcaggaccctcccaagagtccagatgagggctgcttgtggtgcgggctgaagcaatagcagtgaaggtgaccagcctttgcagagatcttccaggtgttggtggcaggacaagctggagtgcatgggctgtgtgagagaacaagaggaggccagatgcttcccagggttgcggtttgagcagcggagagacagaaccttggctttataaaataaggaagatcgagggagcaggtttaatggggagtgtgtatcagaaattcagtcacagacataattagctcagtctagatttcagggagaggcatggaatggaggtataaatttggatgtctttagtttatacatggtatttaaagctatgagactgaatgtggcttcctgggaactaagggcagatagaggagagaagatccagagactgagcctggttccttgggtgtttagagttagggaagtagagcgtctggcagaggagactggaacagagcagctttggggaaggatgggggaggagaaaaaagaagttgttgtgtccccagaagacaagcaaagaaaggatttcagggagggagtgaccaactccctccagtgctgccctagatcgagtgtgagggtctgaaaagtgactcctcctttgcagtgctgcggtctttggtgacttgacaagtgcagtttggtggatggaaaggtgggcaagagagaatgaaggggatgaagtggggacagtgagtcttgttagaggaggagctttgctgcaaaggggaatagagaaatggatggaagatgggttttttttttggttgtatatgtgttttttaaaagatggaagatattttatgctgatgagaatgtcctatgagaaaacatccatgatgcgggggtgggggccattgtaggggtgatgttcctgagtagatggaatgtgcacctgggtgcctgaaaccactagtgttaaatattcattttggggccaaaagtctggggggaatcctgtggaatttttaactcctcagaagagttactgatagactcctttcttcaggagctagggatgtgaaagtagaaagctgagtatcttttttaactcctgagttaggttccatgtagttttacagttttgttcagtggatcataactttccagaaaaccagacataccagtgtaggtatttgaatgtcaagcacaaggtacagtgggaggaacaattcttttgtttttagaagggcttggggaaggcctcttggaggaggttacctttgatctgggccctgaagcatggtgaagattttgttggtagagccgtctgggtataggaaacagtgggaccaaattgggcaaatgcaattttcatggaattttggggaacaacacagaattggtgtggctgcttcatagagtacatgttaggtgagaggggagtcagtggagctgaagctagattggacttacttcatgaagggcattaatttcttgcaggagagtttggactttccctggtaagcagtgggcagtcagcagtaatgaatttttataggagggaaacaatataatctaaaaggtgatttttcagaatgggttagacatagagccttctcgctcaaagtgtgaccgtggacctatagcatcagcatctcctgggtgggagcttgtgagaaatgcagactctcaggccccactcagacctaatggattagaatctgcattttaacaagattctcaagtgattcctaagcactttagagttttgagaatcataggagtctatgaaaactcactaagataatgatttttttagaagaacctttttataatggacattttggagcatatacaaaaggagagatactgtaagaattgagtgtaatctagacttgtgagcagattcagaaatagacatgttattatacacatattttggaactcagtccaatctagagctgccattcaattagccacctgaacactctgaggagagtcacaatcaaaaatatccagagctggccgggcgtggtggctcatgcctgtaatcccaacactttgggaagcccaggagggaagatcacttaaggcaggagctcaaaaccagcctgggcaacgtagtgggactctgtctctacaaaaatttttttaaaaaattgctggatgtggtggcacatgcctgtagtcccagttacttgggaggctgaggcaggaggattgcttgagcctgggaggttgaggctgctgtgagccatgatcgtgccactgcactccagcctgggcaacagagtgagtgagaccttgtcttaaaagtaaataataataataaaaaaatccagagcttctctgtcccatgaggtgttttgagataaaatagattttttgggaagtagcagttaagaaaattgcaccctgggtatgaagagtcatgttcattcttttaaagtctcattcgaattcgttgtatactaggaacactaatgtgaatgaaactccaagctaagctgttttaaagagttttagagttttaagcatatgagggcttaacaaagagcttcacacagaactcccctgaggggtccatcctctggggacaatggtcctttcctaaagtctcacaataacttggtggaaagttcttgacccttttgctcagactgagttgccttttaaaaaattatgcctgatgaaaatatgccactttatcttataatgggtcgctctgtcctacagattctggaatgttaaaatcccttcttactggtgacctctttcttccttccatttccctttcttctgtctttctcactgttttttccccacatcttttattgtttttcatctcacttcactattattttttggctctctttttctgaaactatgcttctcctgatcatttctgtgcctagatagggtcactgctttgtctttgtctttgtgagaggaaatcagggaagcatcttctcccatctgtatgtaatgtattgcaaatttcctggtcatcccagacctctggcatctgacttgcagcaatgattgagggcttcctgatgatcaatagatgtgtaggaggtatggcagtggttctcaacagggcgattgttatcctccagaggacatttgccaatgccctacagacattttggttgtctcaacttggtggggggaggctattggcaactcatgggtagaggccagggatgctgctaaacgtcctagcatgtgaaagtttcttgtattggttcgaaccctaaaagcatgccaacagacaacacaaagcggtgtggagcaacacactgttttaatgagtgcctgggtgcaggcgggctgagacctaaaatgacatcagccccaagtgaggacgggacaggggctttgtagtcctctgtaaacaggaagtgtcccagtctgacgtgactgctacgtagtacctggacggcctctttctcggtcttcaggggtatgtgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtagttgtcttccggccagggtaggtgtcttccggccagggtaggtgtcttccggccagggtaggtgtcttctggcccgctgtcttcctgcttctgctatcttgctgacgcgtgctgctggcgcaagtggccttgagctttgggactgggcctgagaagggaggagttactcatcccttcaagctttcgggcccgggggagaatctttcagcatgcacaaagtaactctcctctaccccaacaaggaatgatctgaccttaaatgtcaatagtgcctaagaagccctgctatgtagtattgaggctctagttctcaagtgaaactgtctttatgaatacctaacatacataaaaataggagcaggcctatttggaaatttctctatttgtgtctctttttataagtagctgaatcaaatgtggaagtgattcagaggcagccacatggagagggaaaggccctggtgaaggagcctggagaactcggatcctgctccttctctatcactctgtcacttaccagtcatctgaccttggcttagtcccttcacctccctttgtttcagtttcttcacctgaaaaatgagtgcttggagtaaatgctcgctgaggtccttttaagttcagtgatgtctaagataaaatttatttagctttttctttctctcaaaaaatgaataacagaaacagagatatggtccacacagcatagtggacttttgagagtacggtaccttcgaccacttttctctgttggaaagtgtgttaccagttttgaagagacaggaagaaacacatacacaagctttgtttgttattagtcatgacatcacagctgctcactggggtcatgaataaagagctgagctaaagcattgtcttgtgggagtaaggcaaggagtggcaaaatgcccattgttttcttttgctatgaatctgttctcttgtgatttcaggtggaaaaccgacagcaggaatccaatgacattcaggaagtaaacatcctgtttagggcagttgccttcagttttgcagacctgggtggaggaggggatggggacagggactcactattggatttaaccatgaacagaaaaatgcccaaatattgtttgttttcccgttttagctgtaaagcaaagagcaacccttacattttatacaggctcccaagtaccaagtaaaatctttcctgtatttccaaatatggatttaaacctttcagagggtaaaagaactttaaagaaggaaaatgtggaaatacagatgaagcattcaagatgaaaaattggtttctgatgtcttggaccacaaccgactagtgttcttcatgcatttaaaaaagtatcagattgtgcagggactcccacatgcggagtacttgtaattccagtccagagttcaggctttgcacaatgtcaggaccctctaaagttatctggctaagacaagaatgtgttcagttgcaaaggattcaacttccaaggcttctggatgttggaatctttgcctcacggtgatttctgatggtagggctagactgattatataaggtgtgccacatttatttctaggattcctaaattggccactatttatcaattaggaaactcactttctatgacagaagaaaacatttctgcctatattcattctacccgtgcccttttcctgctgacatttttacacgataaaatgctatctttttaaataataaaatctgaaccagatggaaaaagtgaattgtctctagggcagatttattatagtcattgaattcagaaatgaagagaatgtaaagaagggatattaaccatatagagcttttacaacacgaatcttcattctctgaattttatatgagatggccatatctccctctctctatatataactttatttaaagagatttaaaactcctcaagaaatgatgctttatttctttcctttaatgactattataaggttgaaattgtttctgttttcttttctttaattgaatctcatcagtttccttctggagtgccaagttttgttttctcaaactctctaccatagtactacttcaaattgttgaaatcgttctgctttcatttccacatattcagaagatacgtatattgttcttgtaatcttttcccagaagttgtaaacagtgacaccagatttcagtcactggtaaaggatcatgtaaatagtagtaatccaagacatcggatacactttaaagagaaaggaaaggagttaaaggaagttggctgtgttacattactgcctcagaaacttcacagtggaaagttaaaaaatcttcccagagagtttgcaatcaatattcattcctgcaaattcagatgccctaagaaggcaattgaaattaattggagtgattataacaaaaatggggaaaaggaggaggggtgaagaacagcaaaaacaagatttaaaactccaatttagaagaattaaaagttataatgtgaaaggaattttttttaaagtgaaacaaaagaaatgaagaagtgatatgccatatcgaagagtctggtattgtctttaaaatatccctacaggacaaagaagaataaaaaccatagttttacaagtcattagcattctaagtcaagtctgcattttagggacatgggtagaaagccctgagcagaaactgatgttctaatagttgaggaagaataaaacaacattgataatcaatggctcaaaaagaagacagatcaatcatacgagtatctcctagggttttctacattaaagaatgtctcttttagaaaggaaaacagacatcacaattagactgtattgtttgattccctgcacagcattgtaaacaaagaaaatgatgacactgcccttgccaccaccattggctacaatttgtggtatgcttacaaggcattctgctaagtactttatatttgtgtcttcttcaaccatcacaaatatgctgagatattgtcctcactttataggatataaagtgaagcttcagagaagttatgtgttttgactaagatcaggcaggtggttaagtgacaggtctgatatttgaactcccgtccaactgactccaagacctgggtgggaagcccaggcatgccatttatagaagagcattgggatctcggatactcaagatttttctccgcatttgcctatatcaccataataagactgcggaagtacatgaagaactagattacaatatcattgttgtgactaatgttttagattgttattattctgagatcttttgtcattatttccattgctctatgctgttttgcctggctgttgctttattattgaatgaacaccctgagcaaggttcgcacacagctgttagaaatgtggaagctagacctttttcctggggaaggagatgggttgaagaatgtgaggaaacaagaccaaattaggcccatcaaaggagaacctgcttcctgttccttgtgcctcgtagcatctgtcactaccaacggaaactcagttctagtggtgaaaactatagaaggccttagccatttttttcaatagagttctatttataacatgaaaactcccttcttggactgtggggaatgagttattgaggtccttgaaagataattttggtgactggcgatgtccttttctaataatagctagaatttattgactacttagtaggaatggtccctgtgttaagtactgtacatacttgttaaatcctcataatgattatgttttattattcttattttacagaggaggaacctggggcgtaggttaaggaacatgtccaaggctacacagtgaataaatgaaagagctgggatttaaccgaggccttaacctctgtgctgcatgacctttactatttttcctctgataaaaatgaaaatatttctcttaagtacttagcttgggaatgaaagacaggtgtgtaaataaccttgactttgggtaattggcttcaggcttatccatcctactccgggccctctcccactcacatttactgtctttctgtatgtcttcctttcataatctttttcttcctccttcttgccgtggaggtttttttttttctcttctctcccttccccatagtccctgcgttgcccttgccttcttagtgcttaaatctgactctggctttgttggcattatttccctggtcttttctcaatctctctttcacgtctcctcctagtatttgaatccctgtttaccaacagcactgaaatgtgacaatgtaaagtgtaaaaaagcaacgcaggacaaccttgacaagtccagataataatattttcatcctttccaggaaaaaaacaaagaggaaagctttgtatctttctttgttccttctcatcaggaaaatcatctagctggaggtctcagaggcagcttctatctggcaaccttccctgaaacagagcaaaactgttctatgattaggagaacaaggtggagggtccggcccagagtcagggtcaaggttgacttaggcttcagttcttgaaggacaaagtgtattagatcctgccctcagagcttggcagaagttacttcattgcttgaaaggcccaccgtctgcgtaaatcttcttaccttttcattatctgcagcgaagacaagatccagttctcagagaatgtattaaaatagaaaaacattttgctgcttttgaaaaatggttccatgtcttattttctgctgatgattaagtacaaaaaattattatttcaaatagattgctggggagagaaaagaactctagatggatagtgttattctttttgtcacggtaatcctatttcttggctcagaagttacacatcatgggagaggtgacttcatacctgaaaaaatttgtattaaacatttgaccaattatagagtattttactgcctatggaatgttaatatgatttaatacgtttacctaaaatctgcattcattaaaaagtctgtgatttgcgcataatcgctgcctaaatgcttgcctcagccctctctgcattgcgtgcctgaagatcgtggggtggctagaagttctgaaccattttcttttatctctcagccaaggtgcatctgtctaatgtcttctaagcaggtgttattaggtgtgatttctggttggctgagaaatcaatgagtggccagctgcggtggctcatgcctgtaatcctagcactttgggaggccaaggcaggtggatcacctgaggtcaggagtttgaaaccagcctggccaacatggtgaaacctggtctctactaaaaagaaaaaaaaaattagccaggcatggtggcacgtgcctgtaatcccagctactcgggaggctgaggcaggagaatcgcttgaacctgggaggcgaagattgcagtgagccgagattgcgccactgcactccagcctgggcgacagctctgtctcaaaaaaaaaaaaaaaaaaaaatcaatgagtatagcagatttcatcatgctcctttcccccaactctttatattttttagtttaacagatctttaagtcctctacaagtgtttagctctttcaccgcagaacctctgcctcattgctgccccagaatcctcatcccactgactcctaaccctcaagatctcagctttcacatcatttcctcagggagatcctccctaaagccttgaccaggtcagctccctctgaagttcagtgcttccctgggaccctggacttcctgtattgtgatgctcatcgcataaattgtttttgtgactctgggaaataaagggcactcaacaaatattagtttaattggtgaatgaatttcttagaagcaaaagtcctagaagctgctttagtatgtttcaaacagtgacatctgagcatgtcttccttcccctatagacgattgcagtcggttggaaaagaatcacacactacaaagttttgtatgttgccaagaatgcctgaggtagaaaactcaattttggttgtctcctctgctatcagttttgggcccctggccttggccacctacccggcatacttgcccttaggaccgaggagttttgttctgtgagccaccaaagattactttggaaaaggaagtcacatactggcttttctccagactgaatttaggttatgtcacaattgtaatcatccagtttggcttcaggaattacttctgcctttacaagttattcaagaatcatctcttgcagttaatactacagtttgatgtctttgatttgtcctagagaggatacctcaaggtatatgtatgtgggcacatatgtgtgtgtgtgtcttgtgtgtgtgttcacagcagccatcttcttccagcaggcctgaagtcacacatgtcatagcatggcttgtattctgtgtcattcttcctgtgagaggtggcagattctttgagtcaattcctgtgagtgctgatggattttcgctgagccattttaccttttcaatcccttccttctatgacttctggcaagtagttgtaagactgttgataattatgtttctctccaggtatctcaaaatgtccttattgacattatatcatttgaaatcacaactgatcagtgtcaggtagatgaagaaggtgttattatatctcttccccagagaggggggtcagtggagttaactgacctatccaggcttccttagttccccggtgggacagccaggatgaaagatagagttttctttctccaggtctccaagcgtcctgtcttggtctgtgtacagaaccaagtggcttctgtagtctaacagacataccagacctgtaaatttgtgacttcaaaccagaatttcccttcagctgtaagattctttacatccccccactctgttctggttaatatataagttagatcttaggactggagccaggctgggtaagaccgaaaagccattggccagtaatcctgtttttcttttcatcattattttgcgatgttgctttcttttttgaaatcttaaaagtttcgcatttgtatctgcttctaaatctatcaagaacggaaagtttcttcccaggactggcacacacaaagctactgtgagccttgggcatgtgtccaggcctttccagaaagcttccctgcctggtgtgctgagaaacgctctgccgatgaggagggcagggctctgcctcgtgttctattgtgctgtttgtgtatgtctttccctttctctgtttcttcgtcctcctcccccttcattcctcttttgtgtgaaaatgcttttttctggctgattgagtatctgagtttgtggtgaactttcaaagccttcttaggctaagctacaggaaggtcactgtcacaaagagtaaaaaaatgtatagatcgccagagttcattaaaaacatcagattgaggaacacaaaatgtccacctaagggcaagtctaatgtggacgaaggctcctctttagaactctcctagttcttctgaggctgcagctctccatagaggtaagtgctgtgtgcccatcagaaatacccacacgagcatgcagagatggaggcaaggatgcacatattttgtagttgtgacaacctgaaaataacttaaatacctgccttccagtagaagaatacttaattatggtgtgtccacatcatgagaaacaataagatagatctagaggtaatgatgaagtatctgtaatatactgctcagtaaaaaagcccatgttgattttctttctatctatctatctatctatctatctatctatctatctatctatctgtctatctttttttttggagatagggtctcgctctgttacccaggctggagtgcagtggtgtgatcacagctcactgcagcctctatctcttgggtacaatcaatccacccacctcagcctcctgagcagctgggactacaggcgtgtaccaccacacctggctaattttctgtattttttgtagagatggggtttcgccacgttgccctagctggtctcgaactcctgggctcaagcaataatcctgtctcagcctcccaaagtgctgggattacaggcgtgagccaccacacctggcacatattatgtatatttaaatatgtatacatatccacagaaaagcctagaaggatatattctaacagttaacaaaaggtcctgggaatgggattaggatgaagggagagagtaggtattttgcttttttagtttatgtacatttgtaagacttacttttttgcaataaataatgagttttatcataataattaaggatcacaggcatttaagaagtgaataatatattagcatcactgactcttacctgtaattttgtgtttccgtctgggtgttcttttcagtgaaacactgtcttgttgttaggctgctactgtttttgacttgagtatatgatatgaattatcacctctccatatctgtttttccatcagtgtcatcataagagtatcttttcactgaaatattaagaaacattaagcaagtatagtggtgttaattagattaattcatccctctttttaaaggtgcaaaactctttttctgtaaaagtcaagctgatgtaaatgcaaatatcaggttttcaattaatttctggctttctggaagaaagtgaaattattgtttatcatttcatttaatctggactaaatatttggagtattgaattatttctatgactttcatttgatggtttcatgtatctactttagatgcagataattgaatattatagttccaaatgctttaacgttccacattagtgaaacaatgatctacaccataatgaaaacagtaacacatttattttctttctgtttgtacttcaattccaaaagttaagcattaaattggctttagtcatacttatgctttgatgatagtccagcttcttggtgtgaaatcaagatgtgaagaaagttagacacacctgtgaaagcccagccttcactttcacatatgtgggtaataacttagtccagttatagtttgttaactaaaaaaacaatttctttgaagtataattaggtgataatgataattttaaaatgtgctaaaaaattctttttggctgaaaaattttggtaaagtgtttagttaagatgaggtgttgtgtctctgtcaataaaagatgcatggattaatgtatagtccctgtcatcttctccagccttcagcagtgactattccgggaccgtatggggtaactggttgctaggcaggcagagtgttctgttctgttctccttgtctgtggcatgtgattgagtcaggagtgttggtaaagtcttctttgaagatgaagcatagaataatagcatgcaaaacattttatcctttttatccttcagctatttgtctctagccttcagtgagtgggtgccccaacctaaagacaacatgctgtgttattactaacatactggagggagctgtgcacatacaaatgaccctgtctctttttgtgccctggaaccttgtcttcccctaggtggactctgtgacccacagagccatcagaagaaatcacctttgcttatcaagtttttgttctttatcttttaaagacataacttctctacctactgtttctgctacttgaaacatattcctctcattgtaatttgagaaacaaaaggataattttatgaggacattttcagtgttcatgctgaagccctggtgatccttgtcaacttgaatttatgcatttatctttccacactcaggcacttcctttcatcagatggatttctggcctaccggcagtcagttatttcctaacatattaggtggcagattttgtgggatttaatttgagcataatcttattgtgtacagattgctttgaagtttcttcaggactcactaaaccttctacacatcaatttttctgccctgtatgggtttttccaaagtttagcctccttaaaacaaacaaacaacaacaacaaaaaaccttatcagtttcactgcagcactccacttaaaacaataaagtttagtttgttttcaagtgctttaaatccattgatgtttctaggaacttttggatgaatgatctgttgaccacccacccaagtttccaggggtgcccctggggtccaccctggtgtccagggattgctttgcctccccacagccagttgggtgcagtgactctccatttgtctttctcagtgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacagtgagtacttgtttgttcccagggaaaaggctagattctgattctccagcctccacgctggagaaaggttctccctgtgctggctaataggaaaccttggtaccctcaaaacaacatgctgctggaggattggcttgagtataaaattctcaagattactgaagtactaattagagagcctagaattttagacagagaagggtattttcaagactacctaatctggctccctcattttatggatgaggaaactgtggaaactccagctcagaaaaattaagtaatttcctggggtttcttctgttaccaagaagagggtctccttgatgaactttaatcttcccttatcaacatgtaccatgctgaacctgaatttgcattttattacctgtttaatggctccttctagccttccatcacaaccactcccgtctagcagtcaaggaatgaagtctagttctgatcctgccctcccaaaagcttggaaaaggtgtttgtccttcagtatggaaaagcatcactgtaacgggtcccctgccagtgcagattgtcatcatttagcatctataagggcctcatcaaaggaagtttctgcagctgtttttccctatttgaagattaacttcctatttgcaaggacaaaggaaaggccaccactgcaggttatgaggtgcttggaactattaggctttgaagaaagtcagaaagaggctgggacaggcttccagtgtgatgttgtatcctctcactggggtgctgggtgacagtttccatggtggctgacccacttggagcttctgacaggcattaccctgaagggatgcctgacttcatcagtaagggaaaggaaatgttcctcagcaccaataaggaaagctgcatcagctccaaagaaaatagacctaaattccaaacaatacctgctgaatttcttatggatgggggtcccagagagagggaaatgcaattgcatcattggaagctgactgccaaatactctatatctcagatgacttcatctgccaggaatgtttgaataccaggggcactcctccagctgcggacctcagctcccttcagggcctccatgcctggctttgtgctggagtgggaaacgctgtgttggagcccagctctccccactggggctgcccctggctctgagcctaattggggaaccggtgggaccagtcattcattgtttccaacacagggactgcaaggcagagctcatttggcaggctgaggcaggggagagggagattgcctcagttcccatgtgcttgttttacccaattttactcctgcggaagaagcaagctctcctatatgtttttaaaaagtaaaatcgtgcttcatgttgttacttatctctggaggagaatcaaaagcagaaaacagtgaaggcatggactatgccccagagagaaaggatcatgtaatcttcatgcacagcaacattatagacacacattgggctgctgtgtttgctgaatgaatgaatggaaagatcaagccttagcacataccctgctccttgactgaagtgggttaggctctgcattgcagggcaaatgggatatatgtatgtatttgttgacaagacgagggagaggccgtttctgaacctttatttgggatcccaagtttctaattacacctctaaattaaacagtgccagagttgtatggaggaagaatgatgaaattagattgcttaacatcctccatgtcatggggttttagcttcctttagcttgtacctgtttgtgtcgcagactccggggataggcagtgatccccttctacgtttttcagtcataacccaaccccattggcatctggaacttcaagtccagggtaaaggggcaatcctcaaatcacatacctgccaccagtataggcagataaccacatgctgccctaaaggggaagtggtgtagggtccactctcggaagctccttttccctggaaaatgaaggaaagccactgtgacttaatccaagatgcccaatagtctttaattctacaaagaaagaaagaaaaggctcaaaatataagcattctgggggagtagtaacatgctgatttacatttctgctaagatataactgaatgtaactagagttttctttccttgagaacaggtttgacaggaaggagtgtgaggggtgtgaaggggctgaggttgggaaacaacccgagcactggggaaaggttccaggaaaggaaggctggggatttaagtcagaaaaccttcatcaaattccagtctttcaaaatggagactggaggtcctattccaggtgtgggctcttctgctttttattcggaatcctgggtactgattttctcttcttcatgctgtgccctatgtaatttgctaattgatgatcttggctgtgataggttcaggtgaatttagttgaagactgttctgcttcatgcattcttagctttgggtggaagttgaaagtgactctgaacattttgagaattttgagggcttcgtcagcatttctaacaccaaaatggctcattttattgcccaaagtcatacctgccttcatggcgagtccttccaggcttctggttataagtcgcccagcaaccaaaaattgcatggttggggtttaggagttagttggattagtcctggagctgatctgatcaaaaagtttgaaagagccctagacaaagggctctctctagactttgcctatcctggctctgtccttggcctaggagccagtgatttgtcagagtgagagcatgagggctctgatcttaatagagaatctaagaacaagcagagatgggaagatctccattgttctcagatgcattgtgcttgtggttgtctccctgtggctgttctggaggattggccctcttcttcctaaacaaggagtaaagtctgatgactctataagcaagattatatacactggcgccaaattactaatcttttccatatgtgaacagatgggcttcccaacacgatctccttcagcctggaagaggaagaggaactggagggtggagagtcagcagaattcacgtgcttctcagaagatctcgtggcagagcagctgacctacatggatgcagtatgtcttctctttgtgatcagatgtactttcacttaaaacataggggagtgatggcactggtgccccggtgacagcagtgggataatgtgattttaagtcttcttgaatccttgagacaggctgcgcctgcagatacagagttaagatgtgtcttgaatcaatcatctgaataattcaggcctgagctcttcttgcaactctaggagaaggtgcttttggagctcaagacacagagggaaataagaattcgaatccctgtgaaacaaaatctgccttgttctgtgggtatttttctccctttacactcataaatatttcaagatctgaactgtttatttggaggattgtaaagggatcaaagtataagttagaataaaataaattcacagaatccacatgtgattgtatctggcccctcatttccacgtgtgctttctgtacttttgaagtttgaatatttttgtgagctggacatatttgagtatgtcagtcagatttcataggtcggtgttagatggtaaatacaagaggactgtgaggagttatcgtggtggctttagctcttctgctttatcacttttgacaaggcagtgtggaacagggtggagattttccttctagtgaacattatcgatgagtatattaattatttacttttgtctgttgaaatggacaccatgagacaaatcaagtagaaaaggattatctggccattcacaaaaataccaatttacaaatgacccagatgacatgctttgccatatgaaatgtctgtgttgtccttaaagtcagttcctcttttgttccagcaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgtaattgtcttttataaaatattctttgtgtttggtagatgcaagagactgctccatcacttcgtttaaatggtttagctgtttggttgaaaaggcagtcaaaagaccatatatgagagcccactgggtttttgttgttcttccagagtaagaaaaaagttgcctttctaaacttggcagcttatttattttcctcttttttaaaaaattggacccctgctcacttcttcccagttatgggctctcacactgctacctctctagagtgagacattctgtctgctttcccctttgtattcacgacaagactgagtgttggtttcagcaccatgttcagtaaatataaatgtatggtctgcatgtcaaaacagactgcccttcaacccagagtgattacctatgccccctcccagtacctggaggcattacatcttctgcagttttgaagagctggtacttcttcagagtcctgaatctcttttctaaaggactgagacacttacagagatctcatattaatctgaggtcatgtctcatattaatctgaagttggaggggaggagtctgttcctaggcctgactcacattcttctgagtgttggagtctagtctcttggatgaactgcttacataccataggacctccccttctcagcatcttatctcatgactgagaaaatggcaacagtgtgcagtcagtgggccaccaaatattttgtgaacttctaatgtgtgtaaaccacaatattctgtacttaggggacatactaggatagagcataattatttgtttgcaggaacccgtacacaaacaaggaagctaagatatactggaattatctcagcctgagacagtagaggagtagggccatgggagataagcactgtaaaagtgggggagagagaaatcatttctgatgggatgatcaaggaaggtttcatggatgaattgacatttgaaattaactttgagtaacagataggatttttggtatttgaagattagagaggtttttttttttctaggcaaaagaaattacatcagcaaaataatgattttgaaaaattattaatatgaaaatatcatattaatttgtgttctgggctctatgggtaaactctcaaccaaaacacattttgctttatgtccccttaaatatatttttccttgagcccctattgatagggcataatgttacattctcttttgctgtctttgattaaagagcagagacacaattgtgccagataatttgccttgagtcttcaggtggtctgttattacagacttcttagtgtattatgaaagtcagcaagaaacaaagagtgtaagttgcataaacaacttctatttctcctattctaaatcgagcttattgctcagcaagtaagagatacaaaagaagttgtgagtgagatatagtgtagaagttctctgtttttttagaatgataaggaattatttttttttttgccataagtgtcacagcatgtctcaaaagcagactgtctacccctaattcattcaactactttggctatagtgacaatatagcatctgtgtatgtgacatagtggggctcaagcgatgacttttggtccaaattgaatgtaaattgtgcatttatgtagtaataagaaatgcaagttgaatcatttgaagtatatttcaaatcccatatcatgtgctaataaagccaagggctcttactttttttttggtgatatcacttcctaatactgagtatgttgtatcttttacaattgtgtagggaaatgtaataaaataatgaggcttaccagtggtttgctaccaagatttattttacctttcctgcattcatcgtagtcaatttctattgaaaggatatttgaaaaagaaaatttttctgacctaatatgactatattttcttggactgcccttaatggtatgtttttacttttgcatcacatctcctggaagatgcctctttttctagaaatgggaccagatgccttttgtactcctttaaacccttagtttaaacctctttttgaataatgtgttccatgtgtttatttcaatttgcatgatgtatctgttcctgagttcctttttttattgcaagtttcctgatttttagaatataacttttgtgaacctttgttgaaccatgctcccataggcttagtttccagattgcaattcagaacatttctcttgttctctctctcttcccctccctccctccctcttttcctccctccctccctccttcccctccttcttctctctttctctttatatctttccaaataaggggaggacattgaggcatttaaaaagggtggacatgacttttattaagtactttggcatttactctaaagaaaatgtttgagggtttgtttggcatagttttcagtgtccagattttggcatgctaaattagagtgctgtttttccttcgtattcaggattaacatttctttgtgaaatgattctcgaagtgatttacatttatgcccaatcactctgggacttcttacctgagatactctacacaaaaccaaatacgtgctcacatggtgtactcacttgtaaacactgggcctagtacgctgtcatgtgcctgtatatgaagcatctcctttgacataaggcctggtccagtctcctcacgttgctaccttccccatgccagccaagaatgggactttctccctgtctgttttgctgtccctgctattcagtcacaggactttgactccaaggtcactaactgctgatgctacaggctccttatggtagcttaagtttaaatagggagcctctctccttacccagaaaatggcatccagaatgtttcctgttctctttctattttgttttaaaacattgccaaaatgaattttattttaaaaggccgagttattttggaagcattgaagtaccaaggtgtttttgaatgtttatggttgcaggacaagccaatttgaaaccaaatgaatgtgtataaaaatatccccccttggctaagagcataaaagccaaagttcaacttgtggtgaatttttattgccaaattatatacacctctgtggacaagggttggtgatgagatgttcaataccatctgacctcaaagtggctgctgcccagctcattttgggatctaaagaagatctaaagtgcatatttttaggacatctgtgtgctttcagcagaagaaagttgctctttctagcatagctctgtagacttacctccattagtgtttttactaggaaagctggaaactataaaactgtaacaacaacacaaaaaaatatattgacgagagaaaaacaagcatactgtgccaaaatctataaagtgtttcgatgactggggtgggaggaaggagccactttttgatgttcactatttatacagctgcctattttgtggtaagaattcatagcagctgtgatacctctaaaacaggaaaccaccaagtcattgtaatattgatagttaaatgccttttatgttttaatcactccccatgcaggaatgtagactcctgaagaatttttcctccttgagggccatcgtttcggcactgcagtctaattccatctatcggttaaaaaagacttgggctgccgtcccaaggtaagttcccaagtgtttgctctgcttttctttggccgggataattagtggttgtgatgagtcctcaccttcaaagcttgtatcgcataactagagaaacatatttgaaatcctctgtgtgtttcaggcagggtgcatcttacacataatcattaatgacttttgaggcagggctcctgcagaaatcaaactcattctaagtataccaaagccaagattattggctttggggatgatttgaaggatgtgcttattatctggattttgagggataaggttgtggagtgatgaagttacagcaatttgccattacttctggttatttttcagcctcactacaaagccctaagctattttaggactcaaggggtaatgtgtgcagataggacattagttcttgatgttcagtaggaaactatttagttgtccttttagtttcagcattttaaaaactatcttattggcattaaaaacctttaaatgttctttcctaagtacctgaaattattaactggccacatcctatgctgtttttcttcatatttcttggtgcaaccgttggaataattaacaacttggtttcctgatttttgcactactgccatcacttccatttccggaacttcactgtagatcaaagaactttgtgcaaaggaaggaaaggtgagggagggggcagttctgattctctgtcactacagatttagaggctggggattgtgtcatgagtacaactaggccagctacattcaacaagtttgcccaggtttgaactagtcaggaagttaggctatatcagggaagaatctataaattctgtatggtctataccacatgtggtatagtcagtttcagttaggaggagagggatgccagctggcttcccagccaggctgccttagtggggcagaatggaaggtctgggtcctcagtttcataagtttactcagagttgatcaagccctaagagactggcattgtttgaatttgcaagagccccaagctggtaaaccagagtttcataaatttatgctgaaaaatgagtgccagaatcctcaagcttgctgataagctcatattctcgttcaggggatagtctacttggtgtaagccaaattatttattaggtgattctttgatgggtaaaaagaaaaaaataaagtggatgtttataatgcctcatgttacagagctgtagaagccacagctacttgcactccaaagctcgtgctttgtttatgacatcaatatttatcagtagaagaactagcaggcttttcaaagaccaatgcaattttcttgattattattctttttttaggttctttcttctctattttgaataatcaaggtgattgtgtgtattaaagagagattagttggttgattttcctctgcacatttctccttaagaacgatggggtcatataaaatcattacttgataggccctggtgaaatgcgatgggaaaatcagaagcatgcagtgtccccacccttcacacctccacttcacctcttctttcccttaccaccactctccactcaactgtagtatagtatcaaaaacaaagggacagtcaagtgttaaaatgtagccttactcaattgattgcaaccttgtctgattgccacgaaaggtaatcctttctttgatggttgaaaaaagaacactaaggaaagtcacgtaaccagcctaagatttcttccacagcaagtttgagactaaaacatgagcaaaaaaaattaatggacttgtatcttagtctccttggctgccatatgaaaagatttattctagctggcttttaaaactattttctaaagacaaaggaaaaaccctctaagctgcattctgtgtaacatatgtttctggtttgtttcttagttggtttgtatgtgttttagcaaggacactacagaagtgtcacagttccttagagaacacacttctatatcagctttacatgttctccattgctaaattcaaggaacaggattaagataacttatttggacatggtacatctatacagtggaatattttgcaggcataaaaggagtgtagtactgatacatggtgtaacatgaaggaaccttgaaaacatgctaaatttaaaaagccagccacaacagctacgtatcatatacttggacttgtatatgaaatgtccagaatcagcaaatctatggacacggaatgtagatcagtggttacctagggctgggactgggaggacggtagggtcccagggtgatagctaaagggtagagggctgctttttggggtgataaaatattctaaagttgattatggggatgactgcacaactctgtgaatatactaaaaagcattggactgtatacttcaatgatatgtggattatatctcaataaagctgttattgtaagaaaaaagatatcttatttggttatcactttccctataatccttgacatttgtcgctttaagtagacaaagggaatacctatttatttctcttcatttagggccacatataattaattttgaaattattttctccaaatatgaatagcttaatggttttctttattatttagagtaatattacactcactataaaacaggctcttaataatggtttttttcataataatgaaaatgttgcatatatagtgatattgcccctattaattctttgtcttcagaatcatgcactcattaaccctggagggtgtgtagagaaaaccatgaggctcacagagatgtagtgtcctggaaagggagaggggcagagcagatgctttgcatatgtggtttcactcactgtcccagcagtcccataaaagcactgtcatatttcccttgtagaggtgagaacattgaagctcaggaaagttaagcagcttgtccaggatcattcagaaagtgagtggagagatgcaattggaactcaccacccctggttgcagagcccatccggttccaccattctctgactctgggagtagaaatagtggcctgtgagccagaaaatttggcttccatacctacaaccctcagcagttattcgtggaaatttgggaaaatccctggttctggcatcgtcatctctaaacttaggggcctggccaagatgacctctcagatctgtgggctctgtgtgtgtaacagtttttttttttttttttttttttttttgtttaactcactgagaagaacatgtcctaattgaacaacttgatgccccaattgaataatccttttttatgattataatatgcatggctagggaaatatacctctctccacaggggtggccaagtccaccttaaaagaaataaaaagccatcccgcataaaaaaaaatcatgggccttatctgtgcttacagtacccaccaaccctgagatcagcacagtccctccttagacatgagtcctgaggacagctgggccaaaagtgtcgggttattcctaactcttcattgttaatattttcttaatcccttttcatagggaccgaatgctgatgtttgaagaactttcagatatcttctcagaccataataaccatttgaccagccgagaactactgatgaaggtgaggctcttagtgaggctgctgtgtagtgctgttaatagctctggaatccattcaaggaagagtagtgtgagggctccttaagttccttcaactccaaagaaagcctaaagtaactagaaggcaaaaaatttttttaaatgcagaatctaagaaacttggggctgagaaaattctaagtccagttgagctctctctttctacctcccttagcttgcctgttatgcaagcagattgtgaaacttgagttcatatgtgtatgtacctccttaacaagctactctgcaaataccaagtgctggcagttaggtgggtgagaggccctggaatattccttctcagcaaaacatctagaatgacagaggccaagcctgcctgcaattccacatcctttatttggactaaattgcacaatctgtcagtcagcagtatttattgaacaccaagtaagtgctgacttctgaatgacacactaggtaaagatatagcttagttcattttatgtctccagacatttgttgaatgcctaatatttgtaaagctttgaacctgcttctagaaatatgaaggtgactaacacaaacactgtttcctggagtttaccatctaattggggtatatagacactaaacaacaagaataaatagtcaaataaagacaactaacaggttgtgaacaaccatcagaggggaactagcatagaccaaatattatcctcatagtctttctataaagtagattttatcatcatcattttgtagatagccaagactcagagagggtaataacctgccctaaggcatacaaccaataggtggtagagctaaaatatgaatgtaatgtggtgagactctaaaacctgtgcttttatcaccaagacataaagctatttcttctgacctttttggagtaaggtgcaggatggatcagatccagcttcatagagaaggtaaattagtagttcagtaaatattggttgagcacccactaggtattggggataaaaccatattaaaggcagtgtttgatcttaaggggattacagtctcatgtgggaggtaaaacatttataaaatagtgtgataggtcctaccataggggaaagtcctgaactgggcaatcaaaagttgtgattcttatccttaatctccttttctataaatgggagccaatcaaagtatttggtctgttgacttcatagaattgttttgaagattcactatggtaaaatacttgaaagtgctatgcaaatgtaagttattttttgtatttggtgagctatattcatgtaaaaccaaagtatgcataacaaatgaaaataaatagagaataagctgcatatttgagcttagggaagatacttggagtaggagtgaaaatcaggtagaggtggggttagtaagaaaaggcatccaggtgctaacccttaggttagtcgatcctataagggcatttgttaaggtcttcatgactgttcctgtcctatgtcctacttatccttcatgtctcagtgtagactcctccttttctggaagccttccttcattctcaggtctgtgctccaggagaagctgtcatttctctgtcctggcacttatcacttgctctgttgcaactgcctgtctctctactggtctgtaggcctcttgcaggcaggggctgtatgtatcttttcactttgtatccctaatgcccaaccagtgcctggcatgcagtaagtgttcagaagctattgtttggctgcatgaattgatgggtcttatcattcacatgactttttaacaatatgcccactattagcccttcttggagtaggtgatatgagaagggcagtatgtgctgatgtctgactttggatttggactacctgattaactgcacactaaacaatcattactgagatcgtgttactccctgcttcacatgcccctggctttgcatactttaaatggaaacccatctggctggaaggagatggcttagtggtctccctgtcagcagtacgaagctagactaactggagccacacattcaaatccaaacagtcctgagtcttccttccaaagtagataaattgaatactgtgcagctcattgcctggtagcagccttctggctgaaggcttagaagtgaagctgtatctagacattaaagatcccataaacctttcttaaatgcagaagttaccccccgtactctaaattaaatttcttatagatatgactcaaattccaaagaaatggaaaacttggctgtgaattcatgtggtctgtgcattatcattaatgatagtgaaatgctttgggcagtccatgtatatctgtaggtccttttccagtcatttttgttaatcattcttcatatgaagtgtctaattctgagtgtaaattgtcagcacattttttttttaaatggaatcacaaggtacttagtttctcaaaagagtcactaggaaaaactaccggcctctgtttctagtgttactcctggttttatacggatttatggttgggtaacaatataatagtttcattttattttattttttgtagatatgtagtctcattatttttctcaggctggtctcaaattcttggactcttagttttaaatgacctaacttctcttcttctgggaagatgtaacgtgccacttatataatatggcccaggcaacatgattattagcaaaaatctgtggttttccttttaattgtttttaaaaatgtttcatttcctctcaaagactatcttaaacctgctatgtccttgtgatttctgaaacctgggtaattctaagcaggtgaattatagtctggaaatttcaagacatcagggaagaaagcagaatgccagcaaatcttggttctcatgattcttggtaagaattttttcggttgactttatataaaggactgctagaaagccccagaaattcaaccctgatggagacgtatgttcagtgacactccaaaacatgctaaactcaaagttagagcaagagtctgttacaactgtgacagttctgagctataattgctggtagctactgagcttaagttaaccaacatttatggagatggatccagagtccagtagacaagttccatctagacctagtagaagagggccctctgaagcccaagaacagcatggatgagggtagctgaactctgctaaagatggttataaagaaaaggtgagacttaagcaagccatttgcactaagagacggagagggaagagaagggcagagggggagataaaaggagagagagagggagaaggagattgatggaggaagagggagatttggcatttatccaaacataggtgatgattaaaatcatgagattggatagtatttccaaagacatgagtacagcagaaaacaagaggataactttgacaaaaagaagaatcactaagagaatatgagaacagcagaggaggcagggggagagaatgagtgatacagtcacaaaaacctatgaaaactttcaagaaggttcaagggattggtgttgtgcgacattgcagagtaggagatttggggctgaggaaggaaaaactgaaactgctggatgtggcaggtaagtggattttcagttgacacctcatttggaataatagggactcgtcggtctttttagatctctagcagggatggaatctcattctcatgaaatcataaagtcatggaatcaacaagtcttgtagctccccatctcaggcgtttctctctcctatctaatgaggaggttgtcttaagtgctcttttgagatccctttcacctctgttattctgtgattcttaggagcctttgaacttttcagaaattctctttaggaattttagccatgtctacaataacttatgatacattattcctctgcccataactgacatactggagggagaccagaaggacctacacaccggaaagaggtgggcactcttattcaagtcagacataattgatttctcactctaagcaaattctcaagaatttcggaggactcacaactatctagcacaggaaaggcgcatattaggctgctttcttttttttagaggtggggtctcactatgttgctcaagttggacttgaactcctgggctcaagcgaccctcctgcctcagccttctgagtagctaggattacaggcgcatgccgccatgtccagtataggctattttcattcatccctgtgaaaaactatgaatgggagatcattaaatagtggctctctttattatcatttgtgatgggaagaacttaaataggtaatgagtcactgtgggttctgtcccagtagtgtacctgggacctgagttaaggctgagagatggaacatgttgatgctctatcactatcagcaaggccaagccactgaaaaaaacccttttgtggttgtacagtagtggaaggtcacgtgctatggtaatacataaatctcaggaaaagtgactaaggaaaaactagtgtagaagttatatactactgaattgtgcaatttacccccccattcatgcagttcctggaaaatgagaacttaacaagaccccaaaaccgcaaaagcacttaatgttcagtcagcaaactcatgattactcattatatagaagagtttgttgttacaatagacaggaggagagaaagggtagccatgtgtcctcaggcaccaggaggaaggattgatttgtaagagttccaaacctgagaggcaatttagaagaactgactgggggctggggatgtgtgaaagttcgacttttatggattggtcatgtagtacaatattggacttcctcagaaaacttccggtgcaaaagtttcatttagctaagaaatgctacagaagtagtccctttctttcacagaatgctggcacatccatttcaggccaagatcgagaaatcacaaaatgtactgaggaagtcgatctttgttttcaggatatctgattactttgagtttaatttgggatctgtaaaaatgtcttcatttatgagaattgcctggcttgtattgatgattgctttcataaccaaatcaggtgatcttcttacaaagtaaggggaaggccaggtgtggtggctggctcatgcctgtaatcccagcacttggggaagctgaggcaggtggatgatctgagatcaggagttcaagaccagcctggccaacatggcgaaaccccatctctactaaaaacaaaaaataaaataaaatataaaaattagccaggtggtggcgcattcctctaatcccagctactcgggaggctgaggcaggagaatcacttgaacctgggaggcagaggttgcagtgagctgagattgcgccactgcactccagccttcccagcagagtgagacttcgtctcaaaaaaaaaaaaaacaaagttgggggaagaacaagaaaatccaagtccaccagcctcgttataaataggcaacttgcaacaagccagccaagtatttgcataatatacatcgtgagagcctgctggaggcctcttcattttgcatggtgttccgagcgagagttatgcagggttgtgtgcgagaaactagatgcctctttacttcttaccattgtggcatcctgtatcaattccctctgtgtgcatttctgtttctcaggaaggaacctcaaaatttgcaaacctggacagcagtgtgaaagaaaaccagaagcgtacccagaggcggctgcagctccagaaggacatggtatgtctggccctcgtcttccctgacagctcacagaggagaagggccgtgtgcgtctgggctcccacatggcactggcaccttcagtcaacagggcacccaggctttcagaaagggtctcccattctctaccccatttgttctcagcagccctgggaggtctataggagagagatgattaccctcattcaactagtaggaagtaagcactgggtggcaaatcctgttttctggcaaagttgttttctgaaggtgagggggagtctacagcaggtcgacttcctccctcttgcagtctcttccgccccctcctgcacttagaagctgctccaccttggcctgagggcctcctgagcttcctactgtagtcagcttctgatacatggtgaccaaggagaaagagtgtcttctccacagggccctggtccttgtactcagagatcttttcatttgttctaatctagccattgcccagctctccttactaatcccaaggctaaccaaatctttatagtttttcaatatttaaaggagcatcatgcctccctcctgaagactgaaagataggtattatcaactttagcttcattttaaacttctgactgttagcataaagtgtggaagaccagagggaggagattagagactgacaaactctaaatattctgctttaagagggttttctctttctttggaaagctcaacgtaagtaagaaatgtttttgaatgataggactcttccgcaacatgaagcctataaaacattcacagtgttacaaacttttttggttgttcaaagacaagctaaaaatagctgttaccaaaaaaatagattattttagtacaggatgagaccttgtacacagaatgggaaggacacactgcagctgacagtgagttcctgaaggacaaaaccctccttggtatgaacctcacaaagcagttctggctgaggaagcagccagcctcatgtcaagcagcctggctttaccctgtttgaggctttgtgttctgccaaaatttccagaattggcttgatgagatttaggataagggatccatggggaccgctttttacttttcctttaggatgtttagtgccttggtggcttactgaagaagagagatgattttaaaggagatttagtgaaatgaatatagtgtatccctgcagttgtaggtagaagtgcctccaccttcatttccaactttttattctggaataagtttagatttacagaaaagctgcaaagctagaagtgcagtttccctcattgttaacatcttctaaaaccatagcacatttgtcaatactaagaaactgacactggcataatactattaactaaaatctagactttgtttggatttcaccagttttccactagtatcttcttatctgttccaggacccaatccggcataccaactgcattttgttgtctgtcacccctgtctcttcaggtctacgacagtgttttcttgactgttttttatgaccttggttgtcttaaggggtctatccaggtattctgtagaatgttccacagtttgaggttgtctgctgttttctagtgattagactgagcttctggatttttagaaagaatatcacagagtaaagtgcccttctcatcacatcacatcaaggagtgaatgaatggtttcagcgtgacatctggtgtcatgttgatggtgacacgaatgatgttgatctttattacttggttaaggaagagtttgccaggttcttcctcagaagttactgtttttctctttccctcctctattatttgagagttagtcaccaagtctagcccaaggggttatattaatagtgatgccccatgcttttgtggtacatacttctctgtgtacaacagccaatggtgaggcaatgactatccagtgccatccccaactaccaggaatgtccccatgctctgaaagagaacagacatccttctcacttgagccaaagcaaaacataaaccccacagtcaacacttttgaacagatgtgtatgatctcctggctttgaggcttggttttcatgatttcacaagttagatattagatcatggagtttctatcctatttgtgtagaaatttaaaaaatgttattcatggaggttagcaccactggcccgcagttaggccttgaatacatccatttgctccagcttgaagattcctaaaacccctcaacttttcaatgacaataaagacagttttgctttggatgctcttcagggtgtgatgcagggaactgtgccctacctgggcaccttcctgactgacctgaccatgcttgacactgcccttcaggactacatcgaggtgagttccatgtgggtggtgtgatcgggcctgcagccttcccactggataccctaaagagtagttaacttctcttagtatcttttgaaggtccaaaagtacatggcattgtgctagctgttaggaggaatacaaagaataacaccaaagactaacaccagaagtggctcaaaatccagtggaagtaattaatatatcaaaataagcagtgaacgatagtaataatcgaaattcaaacaaatgcattgagagaacatgggagatgacaattattattatttttttgagatggagttttgctcttgttgtccaagctggagtgcaatggcacgatcttggctcactgcaatctctgcctctcgggttcaagcaattctcctgcctcagcctcccaagtagctgggattacaggcgtgcaccaccacgcccagctaattttttgtatttttagtagaaacagggtttcaccatattagccaggctagccttgaactcctgaccacaggtgatccgcccaccttggccttccaaagtgctgggattacaggcgttgagccactgcacccggcccacaatgaactcttatgaggggttgtgatgaacagggctcatgaaggagtgggtttgggtttgaacaagactttaaggccgggcgcgatgtctcatgcctgtaatcccagcactttaagaggtcaaggcaggtgaatcacctgaggtcaggagttcaagaccagcctggccaacatggtgaaaccccgtctctactaaaaatacaaaaattaggctgggtgtggtggctcacgcctgtaatcccagcactttgggaggctgagacaggcagatcatgaggtcaggagttcgagaccaccctggccaacatggtgaaaccccatctctactaaaaacacaaaaatcagccgggcatggtgacacatgcctgtagtcccagctactcaggaggttgaggcagaagaattgcttgaacccgagaggcggaggttgcagtgagccgagattgcgccactgcacttcagcctgggtgacagagcaagaccccatctcaaaaaaaagaaaaagaataaataaataaaaatacaaaaattagccggtcatggtggcaggtgcctataatcccaactactctggaggctgaggcaggagaatcacttgagctcgggaggcagaggttgcagtgagccgagatcgtgtcattgcacgatctaggtgcccagcctaggtgccagagtgagactcggtctcaaacaaaaacaaacaaacaaacaaacaaaaaaccccacaagactttaatgttgagtaggactacttggtggggtagagagtcagtcaaatttgtgatttttcaaatatgcttttctttttgtattgctgcctgctgtggggtatttttctctctctctgtctctctctctctctgtccccttgtccctctttctctctgttccccctctctctacccctactcccttcatcccccatcttctctgaaagggaaaatacatgaaaactcagataaacaacttgttagtagcagcaataaaatattaagtgaagaagaaatttcaaatttgaaatgaaattgaaagattgcttgcatatttcagtatatactacccccttgttatcatatgcaaccagcctgcttttattgtatcttaattagaagaagtagaagttactttgcatagatctacctacctttggatttgccacagtgttgtggacacatttattcattttgcatctcctgacttctatgtctcttcacatcctctttctcagcttatctcaggaaacacccatcagtgttggggaattctggggagtaaccaaagatttagaagttaaattcagcctactgagaataggagctgaggggatgaagaattgaaacttaacttttcatgatgctatggagaaatgacttcccttttgataaaccgtatgagtcaatgaccatctgttttagttgcttttggtaagggaaaaaagtgtaatggaatatttactcaagcttttatctttactggttctgcaagtgtctttggatcctgatttgtaattatttatcattactattttagttggtttcagacatttcaagagaaggctttctgcttatcctgccttataataatactttttttaaaagcaaaacaggactctcttcttccacagtagtcgtaattataggatcattgataattgtgactttatcacccctttgatctattttaatgtgacctacgacaacatatggctgtgttttaaagtagcttggttgctcactctttttattaaaatttcttttagggtggactgataaactttgagaaaaggagaagggtaagtagagttgttggctgtgtttcctttgtctgagcatgaaaaaaatgaaagaaatggggacttaagtttttttgtagaggcagaaaaaaatgagttagcacctactgaacgtttatcatataccattttgcttggcattctcctatacattatcccccactagccttatgaggtaggttttatcatcctcaattcaaaggtgaggaagctaggactcaagagattaaattactggacgagaatctcttggtggcaaagccagggttctcatcctgtcctgatgccccaaagcccacatttcttccctgcccactccttatctcctttacaattagcttcagcaatagcaggcttgccacttaattaataacaatgtattttatacttgaagattactaagagtagactttaagtattctcatcacaaataaatatgtgaagtaatgcatatgttagttagcctgatttagccattccacggtatatacatgtttcagaacatcatgttgcacaccataaatacaaacaattttttaatttgccaattaaaataaaaaccaggtttaccctattaaggataaggggtttctgatgagtaaatgacatagaagagttaataaagatggtaaactctcgtgggtatactcgagagaggaaaggaaatggccttcgtcttcggtgtaggtagttattctttccctttcgtgtcagcataggaaggtgtgctcaacatcaatttcactcttcctgtggatagcacagttctgaactgtgctattcaagataaaacagtcttgaaatttttctgtgattttcatattcaaatggcatatttaaatagatatttaaaagactcaaaggaaaatgagtgagcaaaataataacttcaccctgtagtactctcgttatttttcagtactttcacattccacaaatattgactgtctacctaacatggggggggtttgggaattacagcagagaaagaacagagctgcctgccctcgtaaagttcacaatccaggagagaggtagacaaataaataggcagttataatacaacctgaaaagggtttgtgagcagaagtagtgggtgttagagaagtatataggtggggtatctatctccaacttgtagggccagagaaacttccaggagaaaatgacgttgaagttaaaaccaaaaaggcatagaggagctaaacaaagctgggcttatcagaacaagatactaacctggacaaatgtaaattttttgtcccatatagacgatacttttttctttagcatgatggtaaatattccttgaggatactgagaccaagggccgaggtcactggatggcaagttgagacttggagaatctaccagttcttgagttacttctgtcatgtcctgtaatgataataaattcagttattgccccctcagttcccctctctgtcatttaacttcagaataactgtggttggtaatctctttcctttttagactaggatattaaacttctggaaagtttgactgtaaaacctaaacctaaagcttatacccattgctgacttaaattttttttattgaaacatccaaataagtataaataattttcaacataattatgtacttgcctctctgtgagttttaaaagacttagttaaatgatttagtggcgtagtaaaaacccaaggattcaggaaatctaaacattcaattttatgagacctaggactgtttagatactcagccctaccaaaacttatttattgaggggtaaaggttgaggaagatggggatggggatcttgggagctccctgacttaaagtatttcttttcttttttttaagaaatatgaatagaaattaatatattttatgaagtacttaaaaccttaaaaatcatttttctattccaaggatgaaagtgaagaagagaaaaaggaagccactgtaacttaacgtagtgactagtttgggttgctttggtagcttgttttatacaaattgctttctcaaggagaaaagaggattaaaaattaaagcatacaaggactttggagagttctagttagaatttttaagagttagttagctcctttatttttaaggaagcagtatttcagaatcctcctagatggttttcttcatcttttatcctaatgtggtatattttcatgttgaaagattctatatttggttggccttattattcagtcttttttttttaatttttggtattctgtctgctttaggaatttgaagtgattgcccagataaagctcttacagtctgcctgcaacagctattgcatgaccccagaccaaaagttcatccagtggttccagaggcagcagctcctgacagaggaggagaggtgggatcacctgtcgttcatcggggtagaactgaagtgttggcaagaaaaatgctgcatttaatacctcgctgggtcatttattcaacaactatttagtgagcagctgctaggttccaggtccttggttttcaaaggcgcatggtgtggcaggaaaggctgagttgatagcatcaagatgtactttcagactcttgcttggccacttatttatctttgtaaccttgaacaagtcatttgttcttccctatcttaaggatgctcatctgtagaatgtttgtgaggcgtaactaagatcttatgtgggaatgctttgttagaatgcttgtcctcagcgttgtcaccaccaccactgtcactgtgtttgtcattcctgttaattgatggtagctttccaggaagctttcaacctagaggggttgagagactcatgaaactttgaaatatgatgggtaactacattcctacaaaacctatgggaagaattggggaaaataaggaaaatataaaggcattaatatttaggctggctgtaaaggagaaacaagattttgccataagaaccggaagagaacattccagaccgagagagaacacaagcaaaagcttggtggcctgacatgtttggcatttgaaggaacagtgataactcaggtgtggcagggacacaaagaacagtttaaaaatagtgggatgggcatagaaaggcatgttcacttgagtgccctgcctgctggctcagcacgtccctgtcctgtagcctgctcgcttgttggcagattggtctgcaggccatatgtggcccactgcctgtttttacatttttaaatgattggggtgggggggaacaaaaaaagaatattttgtgacacgaaacagttatttgaaattcagatttcagtatctacataaatatggttttattgaaacacagcccgttcatttacatctcatctatggttgctttcatgctgtaaagacagagttgagtagttgcaacagagaccatatggcccacaaagcctaaaatactatgtgatcctttacagaagaagttggcccatccctaccctagcccaggggatttctttggaagtttatcataagggagagtgaaattgacagcaaaataagtatttacaaaaaaaaaaacttgaggtttagagaaatatttgaatgaattaatgacagcatttggattcaaactcaggtctgcccggctctacagcctaagctctgaagatggctgtataatgttgggcacccttccccacctactcagtaacgaaatacatctactgtctacagctacaagctttcataaaaggcacttggaatcacatataaattcctcttgtgcttgtgtcagttatatctgcctggcagatagaggtctgaatctggagcatttttaatttaggaagttttggcaattaaaaatttaaaaaagtatttgtaggccaccctggccaacatggtgaaaccccatctctactaaaataaataaatatatatatatatatctttatcagtaatgtaattgcctatgtctgttcattgacgatcagatagattacaaaagtctcttcattttctttagataaaactaagtcatttgtgcatgtgcacaaacacacatacaaaatagtaggaaggaggtaatagagaagaaataggagggggaggtagtagaggaaggaagattcttccactggcctagcagtgggatgagaatgatcagaatggagttagtttttgatgctgccaaagtgcatatatccttgtatttgaaacacgcagaactaaatagcctcaatccatatgccagtggaggtgagggaggaagcacataagataaatgtgtcaaatcgggccgtgaagtcagtaccccctgacgtttatgataggacaacgtttgtatatatctttactttgaacaattagagccttctctaaaacaaaaccaggacatcatgtgaatttaagtgtgtttttcaattctctaactttgacctcatggagcccccttctctttctcagctatgccctgtcatgtgagattgaagcagctgctgacgccagcaccacctcgcccaagcctcggaagagcatggtgaagagactcagcctgtgagtgtcccctgggggttctggggctccaagagggtgccatcagagtcgtgagaggagatgtattcaacaggatgaccttgagccagggtgaaagtgaagagcactccgctcatttgttaagccgtttatccttctgtcatgaactcaaagcatttgctgagtccattcttctccactcccctctctgttgtgaatcaccattctctcctgcctgaatcactccagtaacatcttcactgtcttctggctgccccttacccaaccattcattctccactaaatagctaggttgtcttttaaaatgtacaccagattatgttgcttcctgtataaaaacccctatagcttttattttaaaataaaacccaaactctgtatcctggtttactaggccttacatgacttaacctgcagacttccctctcttacaacattgccctctgttcaccagtgttgaagacgtttgcactggctgtgcctggcctgaaatgctctttcttcatgactggctccttcaaatattagcaaaaatgttatgtgccaagagagaaccctttctaatgttgctgtccacccctcattctcattcatactagctgcttcctccagtggaatgtaagcaacctgagaacaggaaccttgtctatcatgctcgcagttgtattgcctgaggccaggagtttgagaccagcctggacaatgtagtgagatcctgtctctacaaaaaaatatcacttaaaatattagctgggcatggtggtgcacgcatgtagtcccagctacttgggaggctgaggtgggagggttgcctgagcccaggagttcagtgttacagtgagctatttttgtgccactgcactctagcctggatgacagggcgagaccctgtctctaagaacaaaacaaaacaaaacaacaacaacaaatatatatatatatttatacacacatatatatatacacatacatatatatatgcagtacctagctctcaatatgtgcctgaaaaaccaccattatttttaatgaaatgaatcagttaatatctttttgaggatttggggggatcaggattctgactgtctttatgggcatttgatatttcccagcactgtctctccacctacttcagtgagtcacattgagacacaggcagggatggcacatgaccttgagtgttgccatgtccccggtgtaacataaagacctctgctggatgtggatagcaaggtctcccaccatcagcggccacgcaggctgctatctgccatcaggtgatatgggtggtatgaggcattgtgggtgggttggaacatgcgctttagtagaaagcatctggaagatcatcctgtgttttgctcaccctctctttgttcagatgactgtcctggccctgcggaactctagatttatgagcttttggagtcagctcttgaggagaatttttcatagtatcttgctgtcttttcatctttgcagatatgggggaatgaactactgagataatctgaggggcctgaccaagccttgtcagctggtaagactggcatgtgcacagggaatcagctccctgatagaggagtccagacatgcaggggatcctgggtgtccactctgctcactgaggcagcagaaggaattgggagcttctggacccactatggcagtcagaggttcttaaggaaaaaaacaaaaattctcaatgcaggcaggcctaatcctgcgtcctgctacctctatcctcctgccttctccccatcctcatttctatgctactgcttctctgtactcctctccaagcccgggatctatatgttttgtggtgggagttctaatacccctggatcctctgtcttcactgacacagacaagtggtcagtcctatgaaaacatttactgtgaaatccagagagggcaggactgtgagggtgctatgcccttcacaaagtgtggtaggtactcagtacatctcttactagtaaaatcttgctgggataacccttggtatctgcagttgagtttgggcatctattatgaaagcagttcatatgcccccatcttatttcttgtacatacaagggtgtttgcataccattatttttcaaaagatttcatgatcttcttagcatgtttacaaatctgggaaatgcatttttgctgttcccacattcaatggctcatcattccaaagaggttggagaaaactttgggtgcttaggcctagtttgaaagttagagatgcctactactgagccagaatgaaccttcacaacgcaggacaaagcaggaccttactgaattgtagaaatggaagaaccctagagactctgagataatggatggaggaccactagttgacatcctttcaagatctacctttgtaatttatgaagcagtaagaaagggcattatttttgcttctgtgatcagagtttagctcatacccctatagtccctgtaatgctcctgtaatgcttgaagggtcataaaaggaagacagggaaaatggggctggagatagcagggtagagataaggcagagcaaaaatatgcttgagctcttggaattcaagcatataattccgaaaatatttaataaaaaatcaagttcaccttcattgtttctattattgttgttattttatagtcagtacttgtttaggttcagcccacgtgctagttgccttgcatgccgttccttcttaatctgactcccgccctccttttaccactacttgtggtgtaaatctgttaacggtaaaccttctcagtcttagtctgagaaagtctttattttgccctccttcttagaattatattagacgggtatagaattcaatactgactgttactttcactcagcactttgacgatattattcagtgtcttttgacttccatggttacttttgagatgtgtggtatctgcttaattactattcctctgttttatgttcccactcctgttgcttttctttcttctttccttccttccttccttcctcactcgctctctttctttcaaaagagttttgctctgtcgcttaggctggagtgatcttggctcactgtaacctctgcctcctgggttcatgcaattcttgtgcttcagcttcccaagtagctgggattacaggcacatgccaccacacctgggtaatttttttgtattttggtagagatggggcttcaccacgttgcctggagtggtcttgaactcctgaactcaggcagtcagcctgcctcggcctcccaaagtgctggaagcactttgagagccactgtgcctggccccctgttgattttaagaatttcttttgtctttgatataccagtttaagtgggagtttagtcttaccctattcaggacatggctcttggatgggaggattcctatggttcaccagttctggaatcctctcagccaccatctcttctgatatgggccttcttccatcctctccatgtcttctggaactcctcctacacatacctggggctttcttactgctttctccatatcttttcactgttctttctatgtctttatcttttgatgatgatttttgaggattttcttcagatctgtcatctagttcatgatttttttcttcaagttatttaatccttccactgaggttttagtttaagtcaccacctttttcacttagaggtgaaatgtttttcaaattatcttcttcctttattaggatgtcttgctctgagctccggttttcaatttcttcttttatgtctttaatatttcctaacatacttattttgcagcttggcttatagtagacatgcagatatttgttggatgaataagcacattattagttttgttctgacagttctcaaatttgaagttctcaggagtctaagcctgctttttgttatgcctgttggctctctctttcagtggaatatttccttgtgtgtattttgtaattttgtatcacgagtttatctttatcaggggattctctgaagcctgggctgaaggtatatccctcccgcaagattttctttttttttaagaaaaaatctagtttactagcggtgtcaccggttgagagtttctaaccccatagaccacataaatagcaaattggagtgaggcacagacccagctcacacatgacttcataggagacatttttcttctttccatgctcaggcaagaacagtctccctgttgtcttcctatgctagtagaaagatatttttctggcctatctttttagtaagggtatagccctttgtgggccctggctgtatatagttttggttctaactcctcaccattcataaacagaaaccctcatctttgggccctgggtgtgcattaaaacccatatcactattttgccaagattggggcctcccactcccccaccagagcagctgcagaactagctcgcgtgcttctggttttcagttcctttttcacttaaggcctgtagggatttcccttcctatcttgcaagctcaactaaaaagagtttttaatatttcttatctagctgttttatagaggaagcatttaggatactgtagttcacagattgttggaaatagaagtcttcctccttggtttcttacccaaagcagtgccatcccttctttgcctgtgaagatcattttatggtaggaagtgatgggggtatgctgatggtatcttgatcctgccaaggtggtccatagactgttaaaatgtagaggaccattgacctagaaagacttcagattagtactgaataatctatgtgttctttgaagttggaaatactcttttgggacaagatgtttactactatttgttagaaactttatagcgaatgtcctcctaaaataataatgacagaacacacaagactgaaaaaacatcaagggcttaatcaacacaaaatatttgcctaatcatggattccagatttgtaacagcccaaatgcttggcattctgtttttttccagactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaaggtatatactcaacccttctcataattcctaatgcaggcacctacatgctctttgccacaccacagcaaggaatgtctgtttttaagtggatcactctatagtattttgaaagtcatgttttgaacaggcatcaaaagaagagttcaatttggggacatactactaatagaaacaggtgtaaaagcactaagcagtttcgtttattcatttggcctttgaaatattgttctatacccacctcttaaggcactggagttatttaggggaagtaggacttcttagaaagagcaaaaagtcagagatggagatgtgtcaggttcttggtgccatgttttgtcttagccaagcatttatcacaataatgttgcattgcatgccactccaaaagtcagtgacttaaaacaaccactatttatctctcttatgtatctgctggttggctgatctaggttgggcttgacactaggccacagatttggtccaggtctgttccacttgcctctcattattgttggagtaacgggctacccagggcatgcccttagcatgctaagacggacaagcaagagggcaagcccactcgcaagcatatgtcaagcctttacttgagtcgtatcaaccaacattctattggctaaagtaatcatgtggccacattccacataagtaaatgaagcagagaaataggctccagttttagtgggaggaactctgaaatcacagtgcaaagggcacagctgcaggggaagatgagggattggtaacaaggatacattctcccatgttggaaaaaaggaaactgatgagaggtgataaaagaatttccgtcgagtttctattttctgtgactgcataaataaaaatttaaaaaccaaaatatcttaatcttaagatcttaattaagaccagtcttcttttttttttttttttttttttttttttgagatgaagtctcactactctgttgcccaggctggaatgcagtggtacgatcttggctcactacaacctctgtcttctgggttcaggggattctcctgcctcagcctcccgagtagctgggattacaggcatgtgccaccatgcccgcataatttttgtatttttagtagagatggagtttcaccatgttggccaggttggtctcacacccctgacctcaggtgatccacccacttcggcctcccaaagtgctgggatgagccaccgcaccccaccaatatcagtgttaatcttctgtacacatctgcttcaatctgttggttgaagggtttggatcagaaagtcaactatgacataactagaatttgcaccatttggggaaggtttctggctaaccaagcttactcaatagtgacttctggctccttagcttatggttaggtcagtaaggtagaatgttggcaatggtttcatcccttggtttatatctgctgctcttcaaggggacatgtgtgttgcttcacatggtgttaaaacaacagtggtaatcctggaaccctcaagtgactttgtcataatgtagccaatccaggaaaagcatcatattcaggattcatcaaactgagatgactaatttgctgctctagttggatttcttagctttctgctttgaaatccaggggatacaatcattcatgctctaaatattgaaagaaagccttcgtggacacctacggactggccatgctctcaaaaggcatttttcctcaacccgggatgtagtcattcttcgtgacttgacatacaaattagctttgtcaaaatctggaatgcagtctcatcattcactttttcacagcctctgaggttttataggctccatttctgatggtagacattgtaggaaagtaataactgaggtattgcccacattattgtgggatttctccctgtctctccaggaaggagatggaatcacagtcacaccttgtggcatagtggaaatgtacattggtccaaatggtaccttttaaaactatgcagaagcccagtgtgctttctcctgcacatcccttgcttcatcttttttgtctcatccctcatcagactggctttttaaattcttgcagaagtcatggctctttattctttggatgaacctttctcagagtcatacatttcttaaacatcagtgattcacttggatgcaagtagctcctggactgcacaatccctgcatattagctagaaaggctcgtgattctcctgcttggcacatagctggactgagctgacctccacacttccttcctgacctgagagcctgtgacagccgccttctccaaaagtcctccagactgtcattcttccttttccacaggctgcactgtgaggttgctcttaagggtgaagtgtaatttatttgcattcctttcttcattccccgatcatgatttctaaatattgatttttgcacttgctcctcacttcttaaattctcaataggaatttgggggctcatcaggcagtctgtttagagctgctataacccaggcatattctaggctttatcttaactataaatgtcactagaatcatagaaaaatctaacaaaggaaatagagtttggatagaggaacatgaaggcgaaaaaattgaatgaataattggaaaatgcacccccttaactaatatatctgcaaagaaacttatgctattaacttatctatcatcagttagtcctcaaattgagccactaagttgattcatttgggaacataaggaagaaaaaaacccaaaaaccaaaacaaaaactaaaccatattatgatagagccacaatcagacccctacccatgagaattgtcacatcagctggctggctgtaaactaactgtgcaatagaactgaatgtataattatgccacaggaggaaatctacaggaaataagataatagactccattttaatcagaagcctgataaccagaaagctcaacttctatactgtttccatggaaaggcagataaatatgaaagaaatgttatttattttataaatgacttccagaatattttataggattaacatggtataatttagcttaagtcattccgggaaattctttataattttctacaataataatgggtattttaaatggttcaatttaatgatttttaaaagtacctcttccaataacttctttctttggttattggtattgcatggatgagaaatgtgtagttaatcagaaaagcatattaactgtagtactccatttcttaattgtccttgatacacatcatgaaaatgtatacagttggctctactagcaaatgtggaaagtggtgaagctgcttaaaggctgtatttcccttgagcaagtcacttttatattctgaatcttattctcctcgtctttataatgctctgcattttgttcacaagacagttgtggaattaaaatgggataagataatatgaaagttcatgataagcctcacagtactaaacataccgaggtagcagcatactatgttgattcatcttattgtcatcagccacaggctgagccttggccatgtgcttgctctgggaactcgacagtgggaatcagggagcttgggttcctgttctaggggtgctgtcaactagctgtgtggacctggagccccagttttctccctgggtctcaggttcctcagcagaacaggtatgggactagttgatgtccaaggcctttctagcactaatattcaatgcagagccgtataatctggggtacttctcttagaaacttctaaaaatacagaactttctctctcactacgaaatctgactgcagtaggactgaatcaactgcgttggcaaggctttcctccagccccgtaagcttctgacttctttgggaacccatattgcctccagtttctggtgtctgctgccacctgctggttaacttctataagaacagctaaaacctagggaaatagaactgctttgcctcacgtgcttatagagtgattaggtcacactgagtcaccgataggcatctaccactgatggggactcagagtacttacaccagggatgagacacatgtgtgctgtgggctgttgtggaggaaataactgcagtctatcagtcttgatatctacctctgctttgaaaattgcaaagctgttggccagcgttctaatctgttttcttctggggtgtgtttactcttccagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatggtgaggagcaagccctgacccaggagcgggtttccatttagattgtgtgtctgtgtctgtcggccgctcagactaatagccctaaatatgcacactcaatattagcatatacatatatgcattcacacagaagggatgtgtgtcagttccaggtctccctgggcatagatgctgaatgatatatgtatataaaatatatatacatatatatgcacacacatggtgtatataggatataattttcacatcttaaagaaatgctaaaacttattcgtttaggtcagtattagccatttgaaaattctcaatttgggtgacagtgtaaatgtgctccagggaggatgacacaacctcacacatttttggaagccttcctatggaattatatgtctggttttatcattgaatttccacacattcttagcagtgtactcccctgatggcagatttttgtcatttagtcatttggatcaaacctagttaataaagtggatgatcaagctagaaatacagtttgggttaatgaggaacgatgcctataaaatgagactgacctttttgagcttcttgtaaaatctgtgtgtttctgaggacaattgcaaagatatttttaataatggcagtcttttgggaatacacacagagcctctcatggcgataaccttgggtatgtgaggtctggtaggtttatcacaagaatataaactccttagtttatgggagataatcatgtattggaaatcactttatcctttgcagcaaaatcccacagctaattccacatctctcctcatctttatcactcgcctctttgaaggcacactcagtgcttacaagctcaggtctgaatatggcataagtggtatggaggctccacataaaagctttgctaaagcatttattgagtcaacaaaatatcaaacatttattgcgttctagtcattagatcaggctttggggatagggagatgagtgagacatttctgcctttgaggaacttttaattagaaagggagcccacaaagcattattcacaatgtgcaaaataatagagccaagatcaggtggtaaagggccttgtggcccacacagaggagtgtgttaatcccgcaggcaatagggtcttgttgaaggcttttaagtagtgatgggatttgctcattaagaaagtcatggcactgtgtttgctggagtgtcggggtagactggaggcggggaagcaagttaggaagctgctatcatgttccatgtaggagaggataagggcttgaatgacggtcatgtggctggagatggtgaggatttttgaaagcttttgatgaggtagaattgtagaatccattcatttagttaccaactttttggttactgttgtggaggactagaggctgtctgggtagttggtgggtctgtgagatatgaactaccagaggaggatattcagggacatttaaatcagaggtaccagtatgacatcagatggcattgtctgatagatggtcagaaacatgggctggtgcaaggctggtgctgagatcaaatactgggagttgtcaaaccccacaggggggacgtggtctcgcgagactgagtgtaggatgaggcagaatgcaagtggtaatgagggaggggctaataaaggagcacccgagaggtagaggaaacacagggaagccaaggtcctccatgtggttactgcctgctcagcatggtctgttcacctggcacctcttacctgcaccaatcagagagaatgtccactgcataactctacagtgtctctgaattatagcatggatttgtacaccaaacagttatgttttgggacatgcctggtcagcgtgcactctgctcagtctggggggaactgtgagtggttggactgcacaaacctctactgcccaggaggagtcacaggttgtgcatgctgtctgagtgttgggagggtagtgagcagaagatcccctgccccctgctctgagattcctccttccccagcaaatgggctgcctctgtgagaatcacctctcctgccaaccccttcctgtggccctttatattgcaccaggtggtggcactcacctttcatgaaaatcctgccagcgcatgtcacaggcttattctggagagacgacacactgctctcgtgctctcattctaatcgttaggcctctcaggagaaaccttgctcacaggacgtacctttctgaaatgtattatgctgtgtgctgttgaccagaagatggaaataaatcagtccaggttcaggcgagactagcagttctcaaactttttgttctcaggacccctttatactctgaaacagcattgaatattccaaagagctccagactatgtgggttgtatctgttgatatttaccacattagatatttaaactgagaaactttcaaaatgttgattaattcatttaaaataacaataatgaacacattgcatgttaatgtaaattttattttttaatgaaaaatatctatttttttccaaaaattattgagtgagaagtgtggcattgttttccatttctgaaagtctgttaaaatgtgagtgagactggctttgttttgttttgtttttgtttttactgtgagtacagggtactgaagaatacagtgacagctagtagatttgtagttagaaaccactggaccgatttgtgctgttgtgccagcaattccatccaccatagcttctgcaatacctatgcaaatgtcaacacaaagaaaagacaaacagcatcttagtattatcatgaaaataattttgatctcatggatcccctcacagatttcagggaccccacgggccatagattgcacactgagaactggtggcctagagaacttgctttgcaagagcaactaatgtccctggaatccaaggcccttccatagaagaagagacagcaattagcccttgtaaaattacctcctcagtgaccatggaaaaatgtcttctaccactgaacccatcactctttcgaaatgatctttctctccattgtgtcaatcacagagtcagtctcccaagatcccttacacagggaatgcagtatttctgtcacaggaaagtcaatgagggcgacaccaaagcatcgttcagtaccgcgcattcagtacagcagccactggccacgggtggcgatggagcatttgaaatgggaatactccaaattgagatgagctgagggtaaaatatataccagattttgaacacttagtacaaaaaagtaaaatactgcattaacaatttttgtattgattatatatgctgatgtaatatttggggtgttcaagttaaatatcacctttcaaaaactttttttttttttgaggcagagtcttgcactgttgcctgggctggattgcaatggcacgatctcagctcactgcaacctctgcctccctggttcaagcggttctcctgcctcagcctcctgagtagctgggattacaggcacccacgaccacgcctggctaacttttttgtatttttattagagacggggtttcaccatgttggccaggatggtctcaagctcctgacctcctgatccacctgcctcggcctcccaaagttggtgggattacaggcatgagccacctcacccgtcctaaaaactttttaattgtggctactagaaacttaaaatgaaatatgtggctcacattcgatacctatgagtgctaattcagtctatcagcataaggatgcacgcttgagctgtgaatactcattgtaatcataagtttgattcagcatcgctttgatggtacaaagtaataaacacgcaagggaaagcccttggtcatcttgtcttcattgggacatacctggggaagtttaaggaaaggagaatgaaggtagcctggctgtctcatatgacttacccaccttagcctgacatgcatcccctgaagggaggtcttctcctttagctttctgctactagtccagtgtgacccagctttgggagtattttcttcatactatcaaaaacatattttcctcatttagaattttgtgtgcacctacttttcccttgtaaatgaatatgccagatgttttggtaacagacacgtgaacaagatctttgctgcttacaaggacccctttgtaatgcacattgtttatggaatcacaaacaccagctgctgccccagatcagagtgaggcatcttggcactgccatcctcaggcacacaatggcagtttctgggaggaaatgagacttctgtatgtgtcgaggggggtcgtggggggctttctttctatagtcctcttgccccctggtgagaacagcttttatttttaagtaagaataatctgagttttcattcacttctttcaaacttaaagaaatcacccaaggtatggtacataatttagctttcttttcaggttgctctgcacaccctgcaaatagttggctggcaggcagtgaggtgaagggaagaacatcagaattggggacgagggaaacctttaacttgtgcttttaaaacacttacaagctgatgtttattgaagcataatttgcatgtagttacatatgcagatcttaaatgtttgattctttgagttttaataactatatatatctatgaaactactaccccaaatctagataaagaacatttccatcctgcctgccagattccctgtgccctttccaatcaatcccctcctaacctagaggttcattttctaatgccacagattttgtttttcctttttttgaaagaatagactccactggtatgtaatcttttgtgtccggtttcttttgcctaagatgatgtttgtgagattcacctgcattgttgcatgtgccagttcttagttcccttcagttgctcagtaggattctattatgaatatactacgatttattctcttttcctgttgatggagattcagattgattcagtttttagctattgtgaataaatctgctatgaatgtttgtgtacaagtccttttgtggacgtatgtttttattccgcttggtaaatgcctaggagtgggactgctgaatcacagggtcacctgtactttttgaaatggtcaatgggcagaactgcgaccatttttatcccgtgggttgtaaccagtgccatagaagcagttcaacatgggaggataattttgggccaggactaataatgctttgcatttttcacaattccctcatatatattctttcacgggaacttcaaccactgtggaggagataggcaaggaaagcgttctctccattttaatagcggatgacgctgtgactcagagattaggtgactcgcccatcatctgtggctgctaagggtagaaccaggactagaaaccagggatcctggctcttggtccagttccaattccacgagtccgttctttctggaaaggcatcacaacacaagacagcaagaatgagagggtcaggagaactccctcaggaaacgtgaagctaagtactttacaaacctgttcattgtctttgcagttgacgagccaggataaaacccccgctgtgatccagagagccatgctgaagcacaatctggactcagaccccgccgaggagtacgagctggtgcaggtcatctcggaggacaaaggtgggcatccttccgagacaggcatgttccttcccagggcaggtggctagcacatgtccacagtgctccgcgtttagaaggcagaaaacggatacgtattgttttattgggacctagtggtggtttttgatagtgcaagggtgaacaaccgtgccatcacctcacttgtggaattaagtatctcaaaccgctctccgattccccagctcttgtttttcctgcgattttgatgagtatttcttctgcccagtctttctgagctcttcaaacacttttctaggaagaagtgtctccctgtgccaggaggcagagggtaggggagtctgttgggcattgcaggtggccacacacctcctttacccaagaatgtgtttctaagttgtgtgtgaatctgaaatttagtggttcctgtaataatttctcatcatttcaattaatcatgtatgaaaggtattttctttattcatgatcaattttaaaataacacaaacctctaacttgaaggttatttacctcacatttattgaggcaaagaactggtaatctatgaaaggcttcaatatgcctgggaacatattatttaaagaaatctcttttatgaaatactttttgggggaaataatcacccttgcatgtatctgtctgctaatatgaatttggggattgtatttgttgagagaaggaaacaggctggtagaaaactcctctgtaccttgtcacttcacagacagtgactgtcaggataggtctcttctccaagtgcagaaggagcagcaaatattgttgaccgaagccaaccctttctgccgccagaccccaaactgtccattgcagccaccttaagtagtcctctgctcaccaacaagcagtgtcccctataagtgagaagcattccacaagctaggctatgggatcagcatgtcacccagggctctattgctggtttagaggagagtggctgaaattagaatactaccttctcctagagattaaaagctacagcctctgggaaaattctttttcagtttcctcttggaagatttctcattcattcagctgagccttaggctgtggggcaacactttctcagttataaccttttgatgtaattataattataattctaagcctaaaagatggtctcaagttgtaccattttgcttacaacacagcactaaggtgaggctggtgggtctaaaggtccaggagtctcgaggggtagccaggacccagtgttgcccaccagctgtgtggtcctaaatgcaagctgctggacccccgggccttggtccttaattagagacaataccctgctggttcctcatatatcacagggcgattctgaagataacaagaaatcgtgtacctgaacatggggagacactaagtgatatataactgtgaggactattattactgacctgtgagtatgtgggcagcagcatgggacactttgaggggattgttctccgctgagcctttgtgcacagaatgtacaggagtcacttggaacctgctcatatcagtcttgttgttggatatcaatgtttgaagttaacttaagactcaatttgtccagttttacaaccatatgcctctctggttgcctccccgaccccactaccacagagctagacttgcacattttaccttttttaattctgtttgttttttcaaatactcattacacttgagtgctaaatactgtataccttcttgtggcgattactcaaggatctagaaccagaaatgccatttgacccagcaatcccattactgggtgtatacccaaaggattataaatcattctgctataaagacacatgcacacatatgtttattgcagcactattcacaatagcaaaacctggaaccaacgcaaatgcccatcaatgatagactggataaagaaaatgtggcacatatacaccatggaatactatgcagtgataaaaaaggatgagttcatgtcctttgcagggacatggatgaagctggaaaccatcattctcagcaaactaacacaggaacaaaaaaccaaacactgcatgttctcactcataagtgggagttgaacaatgagaacatgagaacacatggacacagggaggggaatatcacacaccggggcctgttggggggtggaagactaggggaaggatagcattaggagaaatacctaatgtagatggcgggttgatgggtgcagcaagccaccgtggcacatatatacctgtgtaacaaacctgcacgttctgcacatgtaccccagaccttaaagtatagtaaaaataaaataaaaattaaaaaacaaaaataaaagtgaggctgggcatggtggctcacgcctgtaatcccagcactttgagaggccgaggcaggtagatcatctgacgtcaggagttcaagaccagcctggccaacctggtgaaacccgcctctactaaaaatacaaaaaaatacaaaaaaaaaaaaaaaaattagccgggggtggtggcacacgcctgtaatcccagctacttggggggctgagacaggagaatcacttgaccctgggaggcagaggttgcagtgagctgacattgtgccactgcactgcagcctgggcaacaagagcaaaactccatctcaaaaaatataataataataaataaataacttaaataaataaaataaaactgagtcaaaataactttgctttgatgatttcatattacacttggaacaatccttgttcaaaaattacagatgtctagttgggaatcattgaaattgaaaatagtttaaatattaaaagaaggggatatttgctgcaatatttgctgctccttctgcacttggagaagagacctatcctgacagtcactgtctgtgaagtgacaaggtacagaggagttttctaccagcctgtttccttctctcaacaaatacaatacccaaattcatattagcagacagatacccaggaaggggagcatcacacactggggcctgtcagggggttggggaaaaggggagggagagcattaggacaaatatctaatgcatgcaggacttaaaacctagatgacagattgataggtgcagcacatgtatacctatgtaacaaacctgaacattctgcacatgtatcccagaacttaaagtaaaatactataaaataaagatatgcacgttcagcacatgtatcccaaaacttaaagtaaaatttttttaaaaaaatatacatactttcctacatgggaaataaaatactcgtttgacgggattacttcaaaaaatatttcaatatttcaagtagaattctggagtgctgtagattttctgttttttctatgtcattggattctcttagtctttgagaaaatctgcatactggggtggaaaatggactgcaggagaaacgaaacccgagttcaaatcccagttctgctattcactagctgccatcttgggaattttctttaacttttcttggcctctgtttcctactgtactttttttctagttttaacattttctattggaacatttaattcatggagcgaatttctaaaatctcatttgtactaattttttaaattgggattgagaagctggggccaatttttggggtagtgatggtgatcactgtctggttcaggtcacattccagagatgaagggccgtagtcccgttcttgtgtctgggcaaggtttacagctgccgttgtcagtactgagctgacctccacaagctgaccatcttatctttccttatctttttcagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaaggg

SEQ ID NO: 37274 - DNA, 84586 bp, Homo sapiens
ggaggccgagctcggctgggcttggcgaggctgcggcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtaagggcggccgggtcggggcccgggggtcggcgggggaccgggtgcggcgctgcgcggccctcggcgtttggaaacccggagggaagggggaggaagcgcccgaggaggcttctgagcgggagctgggtccggcggtgcggaggcaaggcgggtccccctctcccggtgtctggtctctctccgccccggcgggcgaggactccccgcggcggggcgggcgcgtcacttcactcggatgctttcgtgcgacccagcaaagagcccaggcgcgagtccgaggcggcgggtcgcgtggaaaccctttgctttgaagtttagctcagccttgtaaagatgaaggggcattcgcggctagaaaatgaaaacacccccccccccgcgccaccaaccccctcccggaaaacccttcttcgtgtgcggtgtaggttgtgtttcgactgtggttttctcatgcccagagtgccacgtttggtgaaatcagtgcaccttttgtggggcctctgagatggggctgaagcgtctttcctgttaacttcctatggcgactccttaagtggtcaaggagcgctgattacattccccctgcgctgagaaaaggctgcgctggatgcttgatttttcttgctgtgggggcatggaagccacccaagtggggttgggaagctttgctttagtagtaggcaaggcagatactcgagtggtgaaaactgctgtgaaagagcgagagggtcacgccagacaacagggttctgtctccgctgccaccgtttctgatgaatgagatttgccaggtacacgcaaggcttttatttgttcttagcactgttctgttcgtgaaacgctacgtggaggtcttttccaaatgtttgacggggaagaaaataaagagtaaaccagggttttcactgagggaagcattaggaaaatctttacaggttaagattcgtgagttagggttttcttttgtttgcatgttttcttctcacactctaggtatttagatagatgaaaaatttctcagaatcttcatttgcatttccaaggactgcttgtatttttataccagttataataaaaaagaaatgttgcacaaacctgttttcagtaagcttctgtttcattggtttaatgactgcagaaaaaatggtgggttttttttctccattactagtaggcttgggagcagcaaagttggcatgactaaaagtaataatgatctgagtcattttgcaagtaaactgtgaaataactttgcattttaaagacctgggtggcttttttcaccctgtcgcccccaacataaatctttctcagttaatgttgtttgcctaagtttttacattaataagaaatactgtgttttgatgaggttagtgtatgtacttctcttgtgaattgaatgtgagatagatatgaaataagaggattaagaagtttttttcttgcagtttttgctctcctggtgtgatacgttgtttcagtgtatttctgtgtgactcttagtttgagccagccatccaccatgtttaaagcaattgaaaaatgaatcatctggtggtggtgttttgtcctttaattaggtgactgttagggatggactagaataaaggtcccaggagtaggcttttgcttatgttcagaagagatcagtgtgtcttgatcttagcacggttggcatttggggctgggtaattctttgttctccaggttgtttttgtgcattgtaggatgttcagcagcatctttggcctccgctcattggatgctagtagcagccccctaacctgtgagctccaaaagtgtttccacatattgctagaagtcctctgggggcaaaatacagcgttagttaaggaccactgttctagattaagacttaaatataactgaatgtataatacagaaccagaagttgaatcttgacagtcatcataagtgagttcagagaaagatgtagcagaggcctcattttcagaagaaattatggaattcttatttctttttcttttttctttttttttttttcttttcttttctttttttttttttttttttttgagacggagtcttgcgcagtcgcccaggctggagtgcagtggcccgatctcggctcactgcaaccttcacctcctgggttcaagcgattctccagcctcagcctcccgagtacccgggactacaggtgcgtgccaccatgctcggctaattttgtatttttagtagagaccgggtttcaccatgttggccacgctggtctccaattcctgacctcaggtgatccgcccgcctcagcctcccgaagttctgggattacaggcgtgagccaccttgcccggccagaattcttatttctctaaaccagtactggtaccattggaaatatttcagaatgatttttagaaatctttaagtgactgaattcttttggctgtcttttctagctttggtcttttgcttttccctacctctctcctctctggaaatcctggctgtccctgctggcccagcactctcctctgtcttatccccgttctagtctacccttttgcccagagttccatcaccctagtcctgtaaacagaattctggcttacttattccagaaattcaattcttggaatgttcgaaaacattgttttcctaatttgactttagtagtaaattgtgaccttttggttcttttttgaatccttaaagcatatgtgtaagcagctaaatgaaataattccatgtaaaacacggcagtagaataaactagaaatgtaaaatcgtttctaggtaacgtataaccagtgtcacagccatttacattagatcgtgttcatcttcacttattctgtttttctcatcacatgatgttttttaaatttaaggcataaaatctctaaagtacttttaagacagtctgttaaatatattgcatttttttcttaaggaatgtattgtcattttaaacagctgggctgagtaatttagatatgagacttgcacactattagtaaagattttggcactgtctatatgatttaaatcagaggtatttcactatactgagcagtgaattaggccttaaaaaaagaggagctagtctaatcattgacactaaggaaatcaggccagagtttgggttgtttgtcttttaggtttagtttttatgcttattaggatgataatacttaatagagaaacattttaaagaagtaagtaataatgaaagttttttatataataatgtctaattgttgaggaaattattttttattgttatatctttgagaatgttttaatttatcatccttttaagggcagtaagattaagcttatgctttatttcggtaggtaactatagtatactacttgtacttatgaaatattattttattatgtatttggaggacataagatttgacatacaaataaatgatcatgaatttattttctgttccaaagctttgagcagtattctcatttattccacctcactgtccttccttccgctccactccccctcatatacaaaattccacacccttgtctccttcttcagcttggtttaaatattccaggtttgggggaaaatgagctgagggattggatttcttctgtttggtggatatttttctattgctgccaccaggcagccctttgggatgctgcatcattaatcttcactccttttgaacttgccctgtgacttcccctagttgagaaatgttggctatgcagggcttttgatttttcattgctttgactttcttagaattggtttaggatcttagatgtcaaaaagcccatttccttgaataaacggatccggtatttcagtatgggttgtgtgcttctttctcatggcataccttgtattagttactttagtaagaagccacaggttttggaattgctgatttttttctgtaccttctgtttttcattttcatattcatagttcaagtccttctctgcctctggcagcctaattccaataggctctcttgcatcttgtctttccctctagcctgttctttctactgcagatatcatgctgcttccttgctcagaaacctttgttgacttttccgtttcctgcagaataaaatcttttagacttggcttccctctagccttatactttttccttagggcacccttctccaaacagaaactgttggcacatgttaaagcatatttgcacttgatttctggtattgtttatccttctgcccagcctattttcctactgctgtgggcactttaaaggcagaatttttgtaggttttctttgaatacctaacaacccttctattttattatgtgtaaaatggcttcttaattatgtaaaattattatcttgctggaatataaactttgtgctctgctgttttcaatatcaatgagagcaaataactgtccagccaaattatgtaaacaaaaaaggaatagtaaattatgtgatgaccacagtgaacacatggcatctaaaatcaaattgtttggtttaagattttttttcatatttataagagcttttcacagtcattgtatttgataaattaaagttgagaaaatgataatggatattcattggaggaggatctgctatgttgcaattatggcactttgccctgcaattttttttttttttttttttttgtaaaggtagatctcattttctaatttttatttttggccccaatttctttttttttttttttccttttttttgacggagtcttgctctgtcgcccaggctggagtgcagtggcgcagtctccgctcactgcaagctccgcctcccgggttcacgccattctcctgcctcagcctctcaagtagctgggactacaggtgcctgccaccacgcccggctaatttttttgtatttgtagtagagacggggtttcaccgtgttagcccgagtggtgtcgatctcctgacctcgtgatccgcctgccgcggcctcccaaagtgctgggattacaggggtgagccaccgcaccctttggccccaatttctaatgcataaaaagtatgactgttgttgaatgtctcagtgataggaaacatgcctatcttacagaatttaatagatgttatttaaacctgaaaaagactgctgtaattttttaaacagaaattgtgtattcaaccacaatcaatttttattttgttacacatgtctaactgccttggaaaattctgtgtacaacaaattcacacaggaagacctgagtgtatttgagtgtgtttgttgcagatttcttggtcacatgttctggcatgcagttaaccaatgtatgactccccagagtatgacacagtgaagttcagatcccagactccatttgagtcttacgaactaaggtcagctctacctaatcttttagtgctcagactggtttctgtcataacttgttagtgccaattaaaagccgtaacggaaatagggcaaaaaattttttttaatgaatgttcattaccataaacgtagtgacaacacaaaatttattgtcatacagttgtggaggttagaagtccaaaaagggtttccactgggctaaagtcaggttgttgatagggcttcttttcttctggagattctagaggagaatccattcccttgcctttttcagctctacagaggctgcctgctttcattggctcatggtgccttctccatctcaaagccagcaatagctggtggagtctttctcatgtggcatcactctcctgcctccctttttcacttggaaggacccttgtaattacattgggcccacccacataatccaagttaatagtcccatctcaagatcacatctgcaaaattccttttgccctgtgaggtgacatattcacaggtttcagggattgggacatatttatctttggggaccattattttgccttccacagtccgccctctggctcccaaaggctcatgtgcatcctgcatgcaaaatgcattcaccctctcccaacatctccaaaagtctcaacccaatacagccacaactgactgcaaaatctcaaccagggctcttgatctaactcaggaataggtgagattctgggtgtaatccatactgggacaaaattcctgtctgtttgtggacctgtgaaactagcaaacaagttatctgctcccagaatatggtgggtcaggcataggttatcattaaatggaaagaaaaaaggagtctctagttttgagcactttcaaaactcctttaggtttcaaggactggggatagttctctgtgactctttactccaccctgtgggtactgaacttctccactcttgggagtcatccttcttttctaatgaagggtgtagcacctgtatgctgctgattacttttatcagcctgtttcttgcctctggaattatggtggtctgacagcattatttcatttcatattcttttacttcacctttttcctgtcccgttttactgtaaccagcaagaaaaaacaaaaacaaagaaccggccacatctttaatactttgcttggaaatctcttcatcttaatgtccaggttcatagcttacaaggtctgctttccacgtaactgctggacttaattcagctaagctttctgcctgtatatagcaaggatccccttcctctagtttttgataacatgtttcacctttcttcccatccaagtcctcatcagcagcaaatttaagctccatgcgtctagcaatagtatgttcatgataattcacatattttctaaggtgataatgtgtcatctaccatgcttctcacttcgttctgagcccacactgggagagacattaacatcgtatttctattaacagtatgtcaagaccacctagactttttctattatgcttctcaaaattcttttagcctctgcccattgcccatttctgcatttttaggtgtttgttatagcagcaccccatttcccattatcttcatcagtatcttatatatcacttttgaaagtgcaaaataattgtaattttacattctccagtccctcataatttatgtgactatcatggtaacactaaaagcaccagtttcttacatgtcatattgaacccatggtgttactcaagtcgtaatgtgaaagaataaagcttttctttgcctcttctttattgacatttttcctgatcatccagtctaaattagtcttccttcgtctcccttcctactaataccatattgaaatcatcttgtacttttattttttattgtctgttgcctttctctatggcattggccccatcagagcatgaatcttgtcagacttatcatctgatgggatggcacatagtagctgtttcataattgttggttaaattaatggataaattgttgaacattaattttgactagttttcttttaaagggaaaaattggtacatattctttgtgccttgggtattttgagtgaattttagcccaatatatatcttgctggtttagagtaatgaaaacctactacattattcctaacacatttctaaaaagtaaactaattttggggaccatattcttgttgcatgatcaaaatcatgattcttggtaaataagtggtagagtgaaatgtgattttcatatttgaatattctgggaactttgtttttaacagtattgctgccttgctgtttcacatgttattttgctgctttcttaaaatgcatacactattgcaatgtggcatttaatatatactcacaactatatatttcacacaggatgatgtgactctggtaaacctcagctttcaggagccagcaggctgctcagaggctcaccagcagactgttctttatgtcttgcttgttcctatgtggtgaggatgatcactagtagcatttgtaagatgtgttccatgcttttcctgtcaaattacgcattagccttaccagatccttaagagaatttacagtctacttggggaaatacaatatatacataaagataagtcctcataatgtcaaatggggaagaaaaaataaaatagatactaggtaggggaggtgagtgtcaatattgggacttcattgttgatcttggggggtggaggtggaggtagcttgcctctcagatattactttggttataaatctgtcagttgttttcatgtatttctgaacctactatttaacccttactgggtgtaagctttgtgttgtatggaaacttataatgtagaagagactttgctatctatgaatttagttttctaacattttccatgtctaaggaatttttttcccctccaaggtttatttagctctgtagaaaggctttccagagaggaaaggtgagttgacttagaactctggtggtaaaagttttcccatgagaccttgggcaagttaccaaattttataagcttcagttttttcttctataaatgctggataataaatatatctacttcatagggctagtgacaaagtaagctaatgcatctgaagtacttagaatactacatggtacatacattcttaataattataggctattattataaatacttcagagactctgtggaatcagccctcccttgcagtttcatccatttgtggtcatagacattaaattctttttattggcttttcttagcaaggatgtgtgtgtgtgtgtgtgcgcgcgtgtgtgtatctatatgtgtgcatatatgtgtgtgtgtgtatatatatagtgaagacttcaagaagtataaattcagttttaaacattagtttctaatcccaccgtaacttccttgagggacttggatttctctttaacagcctccttactggggctagaccaggtaaatatctgtgctgtgttaagaattctatagagaatgcactttacataatcagaagattttacaaatgttatagcagtaattttctcttcattttattatccatttttagaattagtgcagtggctttttgcaaacttttttttttttttggaaaataaagctgttagtgtaaattatgaaacgttaagtttattcaaaagatggtgccatttctcagaggagtttgacaactttccacaaaatataaaatcctttctaaaacttcctgcactgttgactcaaagagattcctgatagaactccaggattataacggatttacttttaggagaagaatgtctttaaaagtggtggtaaccttaatagagaaacagtgaattgttgaatctgtgatagtatttgtgccttttaataaattgtaaaatgagttccttaagacttacatcttcagttgtatgaaactcctcctgttacccttgcctcactaaagtacaatccagaattttttctagtaactgatctatattattcatttttcttgtttgggcacatacatcttatttgacagccgttgctgaaggcttactaattttgttcttcatggtatttaagagggatggaacttgtaagtaaacttacagttataatcaatataatgtagtaggagttaaactgccttcttatatggttccgaagttaatctaattccaagaattacatttatttcggtatagcttgaaattgatccatgtatactagctcacttaagttttcacaaactgagcacattcaatcagcaatcagatcaagaaatgtatgcaaggtatattttgttactgtaaaaagtaatggtggtcagtaaagttgctgggactataagatggtgctcctctaattcaagaccaacactgagcacttgcctccatcaattcgtcctctcttgcctccagcacctttttccatccacctgatccactagcatcttcatactgctttaaagactcctgtgtcctggtctcaagtcatgcctagctttaaaagtgataaaatccaagtaatacaccccttaagtaatttttaatctatttttttatttaaacttttcagaatattcagaaaaataggcagtgttcatatttttcctttttcactttgcagtcactctttaaattactttctgctttaaattattgactttctgattgatatagaagtattgagaaataggcagtcatgtaaccatatcaatctatatattttttaaagaggtaatgtggtgtttattcccgtgtactcttctccttctggagttccttttatatgaaggttgggcttctcattcgaacttaattgtaacctctttgtggtttttatctttttgtgctacttacacattttctaggttcatttttatccagttggtaataactaatctacctattaatagattgagctttacattttagtggtgaaatttctatgtctaaaaaccatttctaatctttagcttgaaaaagtgtctgttattctacttctttattttctggctttttcaaagccattttcattatattgtacctatttcatagtctgaaaaacgatttttgaagttcttgagcttcagctatttatggtgtcttgactctgtctcgaggtaaattgtgtcctcttataatttttcatttgtgagcatatattaagcagtacgttgtctgtgtgaatcctgtacaccctgggttggctgcagttttcctttcaatctcgtggatgctgtgtccttcttacttggtttttcccaggcagccctttcctgtagagccagtatgaggtagccaggttctcagctgtttcgagtgctttgccttctctggttatctcaagcatcaggaaaattatatgttgcatacattccacagaggtcccatggtgatggggaaaggtcagctcaggcattccctctgcttagccacacttcatcatactgcttggatacatgttgctgcctaggagactttcttaacccaaacaggccccactgcctttagcagtttcttcatcttctctgacatacaattcagctttggcccagagtggagattaagatatgggtctgactctgcctctcttttccctgtgtgactgctccagttgctcctaactgaatgccctgtagctcccaagcttgcaggctctgccatgggatgcctgggaaagtaaggcacttgtactcttccatttttgtctggatgataccagtgtctgcctcttctcccattattcatgtaaatgcaaaagagaaaaaaagcactttaataattttcaaaaatttctcatattacattctctattgtgtctggctctgaagttaggtttttgtgtttttttcccacaattattcctactgtatgtccttgctgcaatccaagtgctgaccttatttttttagagctcgttctttttaaagttaaactttactatgcatagaagtaattttgaatctttcaaaatgcagattctcattgagtaggtctggggtggggcctgagattctgcatttctcataggctcccggggtgcttgtattgctgagccacagtccagtccatctcagagtcctagaggaggtaatcttctctggttcttttccatttatccatttcataagcatttctcacatcttatctggcctttgccacattcatgaaacctatcactttatcagtaaggtatttaaaacactgccttgcacagagtaaacattcatcatgttctagatattcacatgtacatgaacacacacatatctatcacacttaatattattgctgttttatagttaaacttcttctaatgtcaatctagaaacttgttttagtagtgcattttgagagaaaccatttggtatcatcttgcatggaaacatccgcttccttaggaatgaccaaaaactataattagtgataatgaatcttttatgatttggcaagagtgttttaagtggagttcttttgatgatacgattgttcaggtcaggctgaaagagccccaataataatgtttttctgactgttttcctctggtaatgtttgtgataaaattcctttgtcataaataaatattgttgctggtgcagactgaatatttgtattcccccaaaattcacatgtcgaaaccctaacccccaatgtgatagggtttggagatggggcttttgggaagtaattaaggttagattaggtaatgagggctggtccttcatgatgagattggtatccttattaaaaaaaaaaaaaaagacacaggagctctcttgcttgtaccaagaagtggccatatgagacataactcagtgagggccctcaccaagaaccagaccattctggccccctgatgcgatctccagcttcttgacctatgagaaataaatgttgtttaagccacccagtatagttttctgttacagcaggcttcactgactgagacagttgtaaattctgattaagtttacagtcattggacttgaaataatcgtgctgcttccccatcacttcagctcttctgatctgtaggtggtgcatacaacatgatttcccattgcttttaaaagggaattctgatcttagaaaactacccttcatgtttagtgataagtaattgcaaaataagaactatttggtgattaaacagcatgtgttctatagcttctactttcatcataatatcatttgctggttgggcttagttgcagttacgacatctggttcttatgaaacgtgtaaattcattcaacaaatatttatagaatgccagttctatggcctgcattttctaaatatgtgggaatggaagtctttgggaagctgataaagtacataacacattattggaacatttcaccattaggtaaaaccatgtgttttttgttgctgttgttgttgtttagttatgtttaaatataaaaactgggctgtggattctttctctcatttgtcttgataggcctttgtagtaaatcatcttaaagatgttttagatgaatgcagtttataggtcaggttgagttttactgctttttgccaaaaactatttcagactttcagagctaagcactaagtaaatggactccacagtaatttatactgtgcacatggtgatgcttggaattttagaactaattctctggaaggttgtcaactgacaaatgtccattgtagaattagcagtcccatctgaaataacttaaactgtaatttaaaaagtagtatagaaagagcaattctgaaaaatatgaaactctcaaaaagatcttagtggccccttttggagaatcggtaggacttaggctttgtaattcatagacttgtgtagattttgcattgtatttgggtatatgtcgacgtttatgtccatcagtgaaaaaaatgttattttaaaattaaaaaaaaaacaaaaaacttagaaaattagagcatctgaatgattttgttagataagcaacttaacttttaaaaataaaagctaaaaaccattttgaataatttctagaatgggttcatatccatggagaaataagttgagaaccaaactaatgttttagaattgaatggttgtgttctagaaatgatttagtataagggtttgtctttatttctgaaagttaggattagctatttagattgatggtagttttaataactaaatattatgtggatgtttacaactaatatctccagtttatttgatggaacttttgaggtaaaaatatagttataacttccttgtaatatatttcccacatattttgaggtgttcagtcttgagactgatatgtggtattactaatactaatgtagtctcaatagtcttaattatatgcagtatcagtgtagaaaaaaatataggaattgctttcttttgttctagtatttactttcaaatgctgcttctctctatataaaatattacagctatactgtggacatttagggaagcaaacatttgagtaaatttcttttctcgatgtattttgagtggttgatgttgtattgcaaatgtaactttacacttattctggcttaaatatttacttattaaatattttctgtaaatcccaactttagtggctatatatgttttacagatattccataatttgtttaatcacactaatgttgataattgatgtcgcctacatttacagtcatgtactatgctggaactgtcaaattttatgcatgtatcattgcctgtattcctaattatttgcttaaattattgggttaaaagttttgaacccttttaaagcttatgatgtgtatagatattcaccccctaaatggtccagtttctatccctacaggaggcatgtgaagctgctgtgtttcaccttaccctcatgagcattgagtgttcttgtaattatctgcactaacttgatggataacaatggcttcccattgttactttaatctgcaattttggatttgctgaggggcagtagaaggactatatactctaaagaagttaatgtgctccattttgagattcatcagaacctgtcttgtaatactttacatgtttgtatattcccgctttcccatgtactttttgattttgttattttttcacctagatagattgttttgcttcatgttaatgagaggatttagaaagccttaaattgttggcccatgtaactattccttgagtggttttaacaaggcatttttaaaatttacataattttatatgccttcaggatatacaaactaaagtagagaagaatttgttaaatgagaagaaaaaaggaaactacaatagacaagattgattaattcacgttagcattgaaaacctacataccctaacaaagtgggaccaaacagcataccatctatataccacctgttttcatggaagtgcagattacaatgagatgccatcagaaccggacaataccaaatgttgacttgacagctttaatgtactgttggttgggagcatcaattggtaaaacaattttgggtaaagctttatcaatacttagtaaaggttacatacctttgaatcgataatcccattcctaggtatagattccagagaaagtggtgtacatgtaccaggaaaaatatttactacaacattgttagtaatagcaaaatttcaaaagaactaaattattaatcatcaagagtgaataaatatgtgagcaggaatgaataaataaatgagggtatatactgaaagtgaaatactatgttagaactatagaaatgaagtgctatacggagatagtgaatgtttgataaatctcaataacaatgctaagttaaatatgcactttgtaaagtgatatgctttatgacacattcgtataaagttaaaatatcctcagaactatgccatatgtttataggtacaaacacataaaggaaaactgtaaataaatgcagggagaggataaacatcaaattcagagtgctggttacttctgaggaggcggagagggaagtggatcaggaggatgcatccagggtactgcagtgttttaattctcaagctggatgctggacacacagatgtttattatcttattttctagatatttttatgtgactgaaatatttcgtaaataaacagaacttttgttattgtaggctaattcatctcaattttggcatgtttttctgtgatttcacatccggttatttcccaagccttatttactccttattgcattgcattgtccatccatcatccgccgtttttccatttttacacaagttattcttttgtaatgtcctcctacctggtcttcctccctatgtgcttcccacccttcagtctatatcagtcctccagaatgacagctttgatggtatcagtaactggccagaagtcgtcagtagctctgtttatttacagaatattgttctcttcattagcatggaattcaggagcctctgtggtttggcttccaccctgcatttccatatttcccatgcttctcccttgccacagtatgagaacttcccctgctttcccatcttgatatccttgcttatgttcctctttcagggagtgcccttccacccttacctgtttccagtcctgcccaggcatgttcatgagcagagtttgggagaacttttttcaaagttgagtaatatctggatccctaataaaacagttcttatggattcctaatattgatttaaatgtattgcaaaatcacttcaatatacaaaactatgaaaacatataattaagtagaaaaatgtttctcacttctagataaccacaaagccaaaaaaaaaaaattacacacaaaaccacaaaccaatagagttctcattaacatgacttgttctctcctggttgtgatgtcagtcagctataaactgctttcacatgtggtatgcctactatcaaatgccacaagatgtctcagttcttcccttctctttctctaattgcaaagtcctcattcctggggtgctcccacccccagtggaataaatgcctcaatgaagcatcatcatgaatgaaaaggctcagtagtgttccccaccaagtggctgcatttctacatgaaaaaaatacatctgcctctaactttcaaactgcctaagtgcagatttatttaataaatattacctattgtctgctacagactgtgtcaaaggttgtgtggatccaaacatgtatcatacatggatcctgcccttgaggagtttcgtggcaaaagaaaccaaggaaacattatttacgggagggataaatgctagggggtgtgatttgaacttgtatagggaggcatctgaatttcaagttcagagctgttagtacatggcccttcagctattaaagggcacaagcaagaatatgaagttgacatgtttatttttaattttttcactttgttctcctttcacggcctcttttcagttttttagtatacgctatttccttcagttttctagaactaaggtggcaggtagtattaatctcatgttacaaagcaggaaattgagtttttgatagataaggaatttgcccaagacatactgctagtacgtggccatgctgggtgtcgtctccttctatactgcctctcagtcctctgttatgcttctttccttatgttatttcatgtgtgcatttgcagttatgcaattaaatggtatttttccctctattagggagaaagggcctggtcaaaagtagacactaagtaaatatctgttgaataaattaatgaacaattatatcttatgttgcaagaattaataactacaacaccattattaactgatatacccaacaggtgttttaactagatagtttaaaaggggaaactaagttatgcatatccattgaaataggtcgatgttttgtttttacaaaaacgggttaaagaaaccaacttaaggatctaatctgggggtagattcggtctcaattcttttttttttttttttttttttgaaacgtagtcttgctcttgcccacgctggagtgcagtggcgcattctcggctcacttcaacctccaacttccgggttcatgccattctcctgcctcagcctcccgagtagctgggactacaggcgcctgccaccatgcctggctaatttttaaatatttttttagtagagatggggtttcactgtgttagccaggatggtctcgatctcctgatctcctgacctcctgatatgcccgcctcggcctcccaaagtgctgggattacaggcatgagccactgcacccggccagattcagtctcaattcttaaacacctgcattatttatggctaaaagatttcaaatgaaaagtgaaatttattaaaaaaaaaacctgaggcaattaaatatcctgaatctttgaacagagagttaattatatctaatacactgtatttaccgaagaatgtagacttttatattttagaaagatttttttaacatcattactttcccattaaccaaagtaactaaaatattaaatttatgataatgtgtcacaatgtaaaaatattcctatcattgacaggccagcccctgcatgatagtggtggagattccaagagggcagttaaattaatcaagcttgtcatgtcatagatagtcttcaagaaggatcaaagggttcattttcactttgtattctttttttttcccattaatatggccataatatagttttacatccttggttttgattatacaatgtgcatcttaaaaattagtaagctgtagttaatgcttgtatttttctaataacttttaaagtatgtttgagcactgatttgtctaattatcaaattggaaataaaactatttccaattccacaagttaacttggaataatgtcagaggtattttttctctaatacagtaggaggaaaacagtgaggtggttaataagacacaggtggccgaggtaggatgcttattctatctgaaatgcttaaatagtgtaaatatacaagggagtgtttctggtgagtttgttttgaggacttgtattaatggccttaacattctgaagcatggccctaaaatacttttttcctgaggtcatcaagaaggtttacatccattgtgccatagtcaagaaggagaaaataaatttaggtaacacaaagtggtattttatttttcttgcactttggtgattgcctagttttcttaatctttatatcttctgtaacttctttgtttccttgagcataactcctagaaatatttcaggcaggcaatttacatacatttctatggaaattaggcttatatagtcactgaactgattattttttaaattaattaattatttatttatttttgagacagcctcattctgtcacccaggctggagtgcagagacatgatctcggctcactgcagcctcgacttctcaggctcaagcgatcctctcaccttagccccccaagtagctgggactacaggcactcaccaccaaacccagctaaattttgtattttttgtagagatgaggtttcaccatgttgcccaggctggcctcaaactcctgtactcaagtagtctgcccaccttggccttccaaagtgctgggatttacgggcatgagccactgtgcatggccactgaacttttttttagaaaggaaataaaaggtgcacttttaaattgttattttatggttataatgtcttgtgtttaatagagttctcacttgtaaacattttgttaatggtgtatttttaagcttctgtgtgaatttggtgaattttgtacttggtgtagttatgaaaaactaggattaaacttggtgcacagggattttagaaataaagctgtaatcttccccaagttcttgggtttgctctggaaagagtggcaggaatgaggtggcaacatgattttttgaacactgtgtatacattaatttccagactgaagttatctggggcttcagtttttatttggattcttcttacataaacaagcctctagcatgctttctgttgtttactacaataactttaggttcattgttgacaaataacatgttaaacttctacatcatcttttatagttggttttctttatattaaaggaaatgatgtgcacattgtatatttaagagaaaactataatgttttcctgaaaatggtattttcttgaaaatggtatttacatttgcaagaagttggttttgattattgtcagtggagctttgggctcagcaatagctttctgggctgtgttccagaattatttgagagctataattgtgaaagacttggatttacaacttcctaggttatagataaaatattttttaaagtagattctttttctataaaatatagtttgatctttagtgagatatattactagaggaaagttacctattacctattcagaaaaaaataaaataatacattgcttattttttccattatagcctgattttgaattcaagtttaaatgtattgtttgttataaatgtatttctaactgaagtgatttttcaagattactgactcaatatgtgggattatgcaatttttgaagtattgagctcttcttggtaaaagaaaaagtttaatactttttataatctccttacatgaaggaagacagaatattctgagttgatattaatcaaacacaggaattattttggtttttggatattttaatcaacattgaattgtttttttcttacataaaaagtaaacattcattgatacattatcaacttcagtaatatcgaattctgtatttctatccaatagtacatatataatgcctaacagtgatttctttgggcctctgtaaggtctataatattaaatagagttttcagtgatttccgttaggtagttagaggttatgtttttatttattctgaaatgatttcatcaggattaaacaaacttctgtatgcttaccttccttaaatgtattttatgtagtctagttttcaagactttgtactcttagtcattaaggtgtcaaagtcagtgagtaggctggtgcctttattattgaagatcagtgattataattgaagttttgaaattttaagtagcaatggcattccaggaggaatgatagcacagttacacagttagatgtttaagaaaaaaaaaaatacagtgtgttattgagcagactattagaaaactgctgggcatggtggctcacacctgtaatcccagcactttgggaggctgaggcgggtggatcacgaggtcaggagtttgagaccagcctggccaatatggtgaaacctgtgtctactaaaattacaaaaatattaggcgtggtggcgtatgcctgtagtcccagctactcaggagactgaggcagaagaatcacttgaacccaggttgcagtgagccgagatcacaccactgcactccagcctgggcaacagagcaagactctgtctcaaaaaaaaaaaaaaaaaaaaagaaagaaagcaagctgatgtacatatcagcaagcaagtctgcctctcttcctcgtgaaattcaaaaactaagagctgttggtgcaggcattagttttctgaggctgtggtattcatttgcataatcttctcacttttccagtcctaaaaaatatgttgtactcattaggcatttattgtatgcttatcatgtaccatttatcctgttaaaagaaatgaaagaaaatacggaaataaaagattcttatactctggatgtagcagtgaataagagatttaagatttccttttgcaaggtgaatcaaacaccccgagtgtatgttatgttgtgttatgtcatgtcatatcatgtctacccttataaaggaaagcttttttttttttgagatggtgtcttgctgtgttgcctaggctggagtgcagcggtgcaaccatagctcactctaacctcagactcctgactcaagtgatcttccttgtcttagcctcacaagtaactgggactgcaggtacatgccaccattcccagccaattttttaattttttatttcgtagaggtggtatcttgctctgtttcccaggctggtcttaaactcctggcctcaagtgaccctcttatcgcagccttccaaagtgatggagttacaggagtgagctgctgtgcccagctaaaggagggcttttgagcattgaaatgaatcattgctttctaattctataattttttgacagactttattttttagagtagttttaggttcacagtactattgagcagagagggtacagagctttcccatatatcccagcccccacacatgcatagactcctccattatcaaaatctcccagcagaatagtacatttgttaaaatggatgaacctacagtgacacatcatcattcaaagactttagttttacattagagtttacccttggtagtgtacattctattggtttggaaaaatgcgtaattacatttatccagcattatagaatcacacggagtagttttactgcccttaaaatcctctgtactcctcgtatttattctccctcctaccttatgctaagcaaccactgatcttttttactgtctccatagttttttcttttccagaatgtcgtatagttgaaatcatgtagtatgtagccttttcagattggccttttcacttaataatatgcacttaagtttcctctatgtcatagtttgattatttatttttagagctgaataatattccgttgtttgaatgcaccacagtttatctgttcacctactgaatgacatcttagtttgcccaaattatggtaattatgaataaagctattgtaagcatccatgtgtagatttttgtgtggacatgttttaatgtcctttgtgtaaatactaagggacacaatttttggataatatggtaagagtgagtttaattttgtaagacactaccaaactgtgttccacagagactgtaccattttgcacttgccaatgagtgagagttcctgttgttccatattctcaccagcatttggttgtgtcagtgttctggattttggccattctaataaatgtgtagtggtatctcattggtacttcaatttgcattttcttgatgacatatgtgaagcaccttttttcttttttttatttttgagacagagtctcactctgtcacccaagctgcaaatgcagtggcatgatcttagctcactgcaacctctgtctcccagattcaaacaattctcctgcctcaggctcccaggtagctgggattacagacactcaccaaaacacccggctaatttttttgtatttttagtagagatggggtttaaccatattggccaggctagtcttgaactcctgacctcaagtgattcatccactttggcctcccaaagtgctgggattacaggcataagccaccacacccggccctgaagaatatttttatacgcttattttccatctgcatatcttctttggtgaggtgtcaaagtttttagcccatttttaaactaagttattttcttattgtttctgtgttgattatgataggcctaaagtaagccttgcgaacaagcagtgtcagtactccaactttgttcttctccttcagtatcatgttggctactctggattttttctcgtataaagtttagaatcattttcttgatatctacaaaataatttgctggctaattccgtaactcttaatgaggtgtttgtttgcttaatcagtattctaatatttagcagtgtttccacatacttatgaaattcttgttttctaaagggtgactgaaaaggtttggctgagtccctacccaaatctcatctcgaattgtagttcccataatcttcacgtgggagggacctggtgggaggtaattcaaccataggggttgttaccctcatgctgttcttacgatcgtgatttcacatgagatctggtggttttataaggggcctttcccccttttactcactcacttctcttcctgctgctatgtgaaggatgtgtttgcctctcctgccatgattgtaagtttcctgaggcctccccagccatgctgaactgtgaatcagttaaacctctttcctttataagttacccagtctcaggtatgtctttaattaacaacatgagaacaaactgatagtcacagtataaatggcaaattactattttctcagtttgcaccacgctattcaagccagcctcaggcaatccatccctttcaaattcctcccagttcatcctgggatatgtagggaggacctttcagctataatctttgacctatggctcctggattctacaggaactcttatcattttcctcttttctcactatggctcacagtggcgatgtcttctaaagctgttgacgttagaggtggcatagcttctgccactgcccaccacccaccacagacatgctgatactgctgatgcccaggcttgaatttgctgtgtctatcttgtggccttgaagagttgcttgtgatgttctccatgtcaagctgagggtgccatcctgggccacataataaatttatcttgtgctgctggctcaagttctggtggcttgtgctctcacagtcccacagagacttttgtgaaacaattttttgggggggcttacttgtttgttagcagtgcccttgtgccctatttcagtccaagtccagatgggctgggctaagtgacaccatactcagaaacatagttcttaggcttgtactttgtttttaatccaagctgtgtacattgataccctgtagccccaccttgagaggtgtctagaaaagcctcatttctaggtgagcacatctaaagttcagtcagtactcttgttggcccatagcagacactttaaatattttcatttactgtctttttttgaaaaaaagtgtgattgacacataataattgaatgtaattatggggtacaacatgtttcaatacatgtatacgttgtgtacatgattgaatcagggtaattagcatatccatgactttaaacatttattatttctttgtgctgagaacattcagcacaacactaacatttaaaaatattcgttgtttcctgtttggatggtggagaatctttagttgcggttctctccaggtagatattcttgatttcacttttttgtattgtattaagagtctagtgttcaagtaggctgaatttagtttgaatctcagcttcctcgctggtagtgtgattgtggcacatttctagatttctggggaactcaatctccttatctgtgaaattgatggaaaacacatctcatagggattgcgtgaggattagagatatatgttaagtgtattgggatatatgttaagtgtattgggcacttgctagtactggttatgtagcagtaacgttgacctctctgagttggttgtatcacttattaactatcagtaaataaaggaatccctcctgttacttggctttaaggatctgtgctcagaggcaactctgttgcggatcaatttccttaaagcctctctgggaagatgtctgcttctgtaagtatcacatcaacactctacaagtgacttgcatactctaggtagcctctcctctaagttaggttattttagacagttttttttttttttaatgcagcagtcagaagactgtaggtaacaaaaacaaaacaaaacattccatggagcccagcttctctgtaaattttctggacctcattttggttactaaaaaaaatgggagtaatgagccaggtgatcttttaataactcgtttgtgtttaaaaaattcattattctgtaagagaagaactgttaggctcaattttgtattttaggcaggtggcttccatatatctaggatgtattctggtatttctggtgtggaattaattaagcattcaggagaaattcagtataggtcaaagtttgggaattgaccaagcagctttcagccccttttggttttggtctgcaaacattttcattacgttttaaaaatgaatacttgtgatatccacttgcaaatcaaattcttcattttaagctgtttgccagtgtattatctgttgtgattttgtcagttgtaactttttagaagaatattactttgaattgttgatgtagtccattatgttcttcagaccattataaaaatctgttttattaaggagagtattttggtaaaacaatttgagtatttcctaaggaaggcaaaaagtatattttttatattctttccatttaattccattatttggtgctagttctaatttttagaaaaaaaaatgtcctggtaactaatgtaatagttggcattgtgtagtacgatatcttgcagtcttctccagaacaccaaatttccacaaaccaagtggctccctagttaatcacatctaagaagtgccaaatggaagtaagttaacagacttttaaaatatagtactcttttgaatctttgatacactaagtgaattgtgaatcctcaaaaagaaagtagagtatacacctactaaactacctagcctggtattcaaagaacagatgttgagattcttcatgatattagtgttccaaggatatggtttgtgagaagctcattatatagtactttgtagtttataaagtactgttgcattattaccttatttgtttctcacaacccttttacgtattgttttactggtcaggtacatgagcatctgagaaattgttgctgcatattgaaggcacatacttatttacttggagattaatttgtgttaaggaaattagaatcttatatcagcaacagtatttttttgataagcattttaggagttaattgagtacagctctggtgattacagagaaatctgttagaagttgttgacacaaagaatgagttttaaaaatgtcaactattttaccactgggcatgctagtgaaattttccactcaattatgtttgtgtcataattgtttgtgtcaaacaaagaatttctttaaatgtcatatatttttagcagtgcattatgcattatggctgtgcaatataaactctcttagtttttattaaatttaaatgtgtgttagcctgtaatgttatcgttaatgctgtgcttgtttctaaagtgggagctccacaactcaaaatactctgaatcatagactaataggaagttgagtccaaagagattttttttagcatcccttggtttatactgctcttcaaaaagctgaaattacccctgaaactactggatcatggaattatacagtatgattgaaagtcactggaaagatgctcagttttttatttactggtagatacttatacagtgcttaccatttgctaccctatgtcctaaaggatctataaataccaggttatttaatagttatcgagtgtctgtgctgtggactgaatgtgtccctccgaaattgtatgttgaagccctaacccacagtgtgatggcatttggaggtggggcatttgggaggtaattgggttggaatgaggtcatggaatggagtcctcatgatgggcatgaagggaccttgagttctctttatcatgtctggattcagcaagtaagtgactggctgtaaaccaggaagagggccctcaccaagaacctgaccatgttggcaatttgatctgagacttctagtttccagaactatcagaaataagtgcttgttgtttaggccacccagtctgtgatactctcttacagcaacccagactaagataatctgctcctgtgccaggtagttagcctggtctttaaggcattttatgaaattctacagcacctcactgaagaagtttgtattattttactcattttatagatgaagaaacagatactcttctagaaatgtgcttctcaaactgaaggtacacagctgtatggcaaggttaatacaagcaacaggaaaagaactatcctacatctttacgatttggctttgttgctgcacaagcaaaatcagctgaattcttttcagctttatattttcgaagagaaagttgttcttggagcttaacatttcagtaccagtggaaaatctctccacctacgaagaaaccctccttgggttgaaggcatactttgaacagctccttgaggttggggaatagatggttaagatacatacctgggataagtaataaaatggtccttattcagccacacactgggatttggtgtggctgagcacaatggatgggttttgagacatcctgtgggaagagatttaagagagttgaggtggccttcagtgaagagaaaccgcaaggaagaatggaagtgtgtgggtaatattgataggtttctgctctgcattgtttgatgttaatcttattcttgtcttcccacaaaatctttaaagtgtttgctttaaaaaataatttgtaaaactgggtttgttttagggaatgtggccaagtactgatgatagattcaaggaagacttagaggacttgctgagacacccaagggaggctgacacccctgggtttcatctgtctatctgggacttgtgttgatttcctctggcagtatatgtgtcagttctcttttatatagcatctgaaggttttacatgtttgaaatacattgaaatacagaatggtccctatcccccaggacccctcaatattttatttaagctacataattttacttttgtaatcatctttatcctacacctcagcatgcatactactagcccttctgtgggtaggttcatacctgtttaccaaatgcaggtgtcttctgaacagtaatgagttcttacaccttgcttgatctctacatgtcctcttaataagatggtctgttcgtagtagattctccatcactccattgtgtgtttagcgaactcttcactgttggcacattaattatattcaactgaaattcacttacataactacttagctcaaaccagtaacacatatttgagaaactgagcattttgagtccaagttctgtgttttacattaaattaaacatatgtgaagatagttttagcccattattgttgaattttgagatatttagagacagtagttttccttttgtctttttgcctacctcatagtcagagtatgaattctgttgcatataatccacatgttgatactaattcattaatcagtattctttagagttgccccacaaggtgcaaacctacgtaaactggaggccagccttgtattcttgtattgaacataagaatatcatgcggcatattgtaaaagcatcactgagattacactgctctaggcctcagatatggtccatgccttttttcttgtgtctaatagtcttatcaaaacagaactgaccttttttagtgaatctatgctgctttgtcaaactggtgctttcttttttttttttttttggtggggggaccgagtctctctctgtcaccaggcttctttgtcaaactggtgctttctttttttttttttttttttttgtggggactgagtctctctctgtcaccaggctggagtgcagtggcgtgatcttggctcactgcaacctccacctcctgggttcaagcaattcttctgcctcagcctcccaagtagctgggactacaggtgtgcgccaccacatccagctaatttttgtatttttagtagagatggagtttcactgtgttggccaggatggtctcatctcttgacctcgtgagctgccacctcggcctcccaaagtgctgggattacaggcgtaagccaccgcacctggctgctttctttttttcttgctttcctttttttctttttttttgagacggagtcttgctctgtcgcccaggctggagtgcagtggtgtaatctcggctcactgcaagctccgcctcctgggttatgccattctcctgccatagcctccctagtagctgggactacaggcgcccaccaccacacccggctaatttttttgtatttttagcagagacggggtttcaccgtgttagccaggatggtcttgatctcctgacctcgtgatctgcctgccttggcctccccactttctttttgagtactcacattttactttttaatgagttgtcttcagaattggcagaagttgactctagactttacctaattttatcactgcctcttttaatttggggcatttatccatctctgctcttctctaacatcctccatgatttctcaaatttcctttgatgagtttacaaagataccagtaattggagaagcaaaaatgatgatttaataatagctgattgacatttcagagcattagtataccacttacttctttactcgacctttttaatagcaatggagaggcattggaaaaaaggatatatgaaaagttagaaaatacgcctatgagaaaaagctaaagatgacattatttgtctccaaaaaagagaaagctcagactttatatgtgaggatgtattgtagtagccagctcttttgtatgttccaccaagaccgaactgaagggaattgatttaggctgcattattaagggatgtatattgagtattaataggagttttatgattctgaatattgttcatctctggagggactttttggtagaagttgtgattcctctcccctcttaaatctctaaaaataacatcaattttcatctctcagtaatgttgtacagtgctcccaaaggctaaaagagatattaggtgacctttcaagtcctttcttgctcagtgactttgtcttttcacagatctcactccacagctagagatctgttgcattagattcacttttgttctttctttgtcatttaaagggctgttaacattccatcatgaatctgctaatggaagggtgaccctgcagtttaatatactatcctagtgtaaaaataaaactccactttgtatgtttatgtaaaatacagatgctttatgtggtatttcagttatttaaaaaacatgagatatttgataaattatttttaaagacagtctttattttcagtttaccttcagagttttggcagaatgttttctctttctcttgtgaaattgaacatactgtgcatttatttttattttttcattcaagcactttatttctagttcttttagttaacatattctgtaactagaagtagtttttagtataatagtttttaaaaactagattaccaaagaacaaatgctatttgagaatataatctctcaaaatttctgatttggaaataaatcatagataaaaaatcaaggttaatatgtaaaatactttgatagcagttactgtaccatttggacaatattatctcgtttgatctttgttacttttacttcgttgagaactaaatacagagagggtatattaatataaaaccttggactcctagatctcagcttacaaatagggattttgggcaatttgcttaatctttgtttattaaacctcagttttaccatttatagtctagcatggtaatggcacagtgcttgtttagattgctggaaaaataaatacagaatccttagcatagtgtttgtcacatagtaagagctataaagattattatttttatgcattaacaacagattacattttgcttactaccattcactaggcattatgctaagcagtgagcatataaggacaaaaatatttcattctttgcactggggaatctttcatccttgtattggaaacataggtagaaacatgtaattgtgatatgagtgctcatagacatgcagtcttccagaaagtagagttggataataatttgattgttggagaaaacagaatttcgaaattgtttaaaaaaacagagggggttactatttctttagattgttctcattttagcaaaatagattgatacattattcttacaaataatcataaagtagacataaacagttttcctttgcttgaatataaatgtgtttagaagatagttggaggaactggagagcctcttagttccatttacatactgatattaatattctaagttgattttaggattactcacattcaatttatattctaatgttgtttatttaactctacatgtgataatttacttttagtcccttaaaatgacatgggtgctttggcaataatatctatatttataaagttactttcagtttgatatctcccacctctcactaatactactgtcatagattggggatgaaatgttacaaatgaatcttctacatgtaatacatgtgtatacctgtggttcttaaaaatgatttgctgcagcttcccaagcaggttccaggtgctcttccctttttagtctttagatttataagttgacaagatgtataaagcacttttgtcatttgaggcttatttgtcatgattagagtatattacctgagatgtcaaacagcctgtgagagctgatgaggtgactgtcatcattataaataatagccagtgagagtgagtgggttaatggattgccatttcctggtagtgtttaagaagctaaggtcacctgagaaccattggtggtttcatagacttcttagagttggaaagaaacttggagttaccccttcagcctcacagctaagataagaatgacctttttctacatctctgactaatggacatccagactcgaacactgcacatggatgcatggaagaaagacaagaaagtttttccttgcaatgctcagcattatgtggaatgtagacatttgtagcgtctgtagtatgtatagcaggaggcgtatgcagttaggttcacttttctgtgcttaagatggtggtcagtgtcacaaaagtgaagatggagtcagaagtctggcaaaggaaaagattttcgtattttacttcacctggagtagtagctcccatcctgccagacccgatgctcacttttgtaatataattttaatgccccctataatattccgaaacaaaatttgtagataatagtaacctattttcatatatttactaaaaaccactataatatgcccatctgcaatatattagagaaataaaagtaatttatcccgtttttcagtatgtaaatgctcagccacaactgtgtctttataaaagttggatgcttgtttccttatatagaatcatttatagttcactgtacatgcaaactgcaatagatgtgccattgagaatatggcatgcagaaatggtgttcaactttactgaaatttccaaatgacaaggattacagtcttctctcttttatgcagtagttgcattgctggaaaaagtcaacacatatcaaaatcatgcaaaaaaagtctttgtgtttatgtggaaaattgaattaggtagtagattcagatattataaagttacgatttttcaccaacaaaatataggtcattagcaaattgtgcaggacatggaaagtactctgttgatgggattcttctgtatatcacagtagtatacccaaccacaccaatgaccaaaaatgttcccacaaattcccattaaactgttcctgggctagcgctatcctttttgagaatcattgcccttagctgactccatgagaacttcaacttgcaacttgaagccctaggtgctgcctcagactagagaatatacaagaaatggcatttgacaggtgctctagaaatctctagtcatgtacttaaccctctttttactcatttactcggtttttaaaagattactgtgaaatgtattagaaacaagcccccccatgcatacaaaggccataactagaacatctgattcacttaaaaattccgacaaaatatacataatattcaccattttaattattttatttatttatttatttatttttgagacagagtctcactttgtcacctaggctggagtgcagtggcacgatctcggctcactgcaagctccgcctcctgggttcacaccattctcctgcctcagcctcccgagtagctgggactacaggtgcccgccaccacgcccggctaatttttgtatttttagtagagtcagggtttcaccgtgttagccaggatggtctcgatctgaccttgtgatctgcctgccttggcctcccaaagtgctgggattacaggcgtgagccaccgcgcctggccaattatttttaagtgtacagttcagtggcattaagtacagtcacattgttgttcaccatcaccagtgtccatctctgggacttctacatcatcccaaattaaaactctttaccaattaaataataaatccccattgcttcttcattcccagctcctgacaaccactatcctacgtttctaaaaatttaccctactggtttgactaaaaatattttattacaggtttttctttttgatgatgttaggttgactgtctttttatgttacaggacctatatattgcctctgttgccagaaacttacgcttcattttgtttctttaatgttgcttgttctgtcccttaaatgtaactaataatattctaattactcttctttctgtacttctgtccctgattcttttgattttgtcataaactatgattttcccctttaaaatgttcttagatttaaaatagggggtaagaactgtgtcttgacagatgacaattgtagttagattccgtagtctacacgtggcttttgcggtggttttccatccacttgcctctgctctctttaataaagttctgttgtgactgttaaaaggcctaaaaccttttaacgtttgcaagttggagacttataggctaaaatttcctcctgagggaatccttttgtatttctagtatcattttaaagtaatagacatgtatcattttctcatatcaaacaccacccctatctattaggtaaaatctttggacttctattttatataaaatcagtagtctttcagcaaattgtgtattcagaaatgctacacaatagaagaggaggtggaatgaaggttccatttaggaacagtttgctcttagcaagtaaccaggtgttagtgtttcaggatgacttcatggaagggaagtcattgaaatgtctataatcaggtttttaagtgtcattcccaaattatcttgttgattattgattaccaaattttattaacttttaaagacagttttattgagatataattcaccaaaaatcattaaagtatatttccataattttcaagtttaggcataatgtcgtgcagccattaccataatcaattttggaatatttatattaccaccaaaaatttcatgacctttaccagtcacttctcatttcccacaaaacccacacccttactcaaccactggtctacgttctgtctctatagatttgacatttctggacatttcgtataaatggaatcatataatacgatctttggattctttcactgagcataataatgttcataaggttcctctacattgtcacatgtatcagtactttgttctttttcatagctgagtaattccattgtacagacgggctacattgtttacctctttatccgttgatggacagttgtcttgtttccaccattttgctattatgatgctgctataaacattcatgtacaactttttgcctgtgagtatatttcatttttgttgtgtatgtatgtaggattgagtgtttaaccttttgaataaatgccagagtgttttccaaagtggttgtaccatttacattcctagcaagcagtgtatgaagattccataattcttctacatttcagcaatacttggattgtctacctttttattatggccatcctagtgggtgtgaagtagtacctttattgtggttttgatttccatttccctgatgactaatgttattgatcatcttttcatgtttattaacctctctgaaaactcaagtgtacaaaatccctaatggaggccttattagtccattcctgcactgctatcaagaaatacctgagactgggtagtttataaagaaaagagttttaattggctcacagttctgcaggcagtacaagaagcatggctgggaggcatcaggaaactttcagttatggtagaacacgaaggggaagcaggtatgtcttgcatgactggagtaggaggaagagagaggcgggaggtgatatatacttgtaagaaaccagatctcagataactcactcactatcaccagaacagcaccaaaggggaaatctacccccatgatgcagtcaccttccaccagctccacttccaacattagggattacaatttgtcatgagatttggctggggacacagacccaaaccatattagaaactctaacctggcagtttgctccattagtgatgatggatcaaagggacatagtgtatttcattaattctaagatagacatttttcacatttgacatcactaaaatcagtgcattttacagtaaatatattatggctttagtaaagacagtttggaaaagaaaattcagtttacagttgaggttcattacttctggttctcttagtcctagagcaactgattcaactagaaactaaagtatattgttaaattaggaccaaatagttccttctcttacagctcatcagattaaaattatgatgtgatgcctgtttacctacgtacgccttttctgattagtatttacttgccaatttataggcaatgataaatttgatgtatttatcctcattaaaaaatccttgtaaaaaatttattaatttattgggtgtttcctcaagatttttttctatgttcttctttgtaaactttaggtctctgtgtgtcaatgcgtgtgaaatagtgcagggatttagtgaaggctgcaccatcatttatcattgttagactcactcttgtctggcaaagacagctgacgaagaaaaatattgaaggcttgtcttttattgatctccactggactttgacccttgcagaaactggctatggccagaatgtatgaagacaacgtcatcttttattattgatgtttattttaatttacatcttgatgtaaaatggcatctagcgaaactgtatgcttcccatagtattatagaaaactagggtgcagggcgaaacaatcctattgacagatgatgtactttgatagattctggcatcagattattagattatatcttttccggaaccaaatttgcttctgtataacttctgtttttgattttaaatttcagtgtcttagttacacagtatgacttctctttcataggagggctcttcagttatttatcagacatcttatttacactagtcttttttccttctaaacattccttcctccctcagcttttcttcaaatgaaatagtttgttttgtacaccacatctctgtatataatcctatttgtgtgcccttcctggaaaaatgtctttaaaaatgatatttgaaagaatagtggtccagtgaaaagtataatagtacttgtacttttaggattatatgaacttgtacacattttatttgtatcagcctttctgtaatcttttactgtcattttcttgtaatctgagctttttggaattaggacctacatgttatttaactttgactagatttcttaacgttgtcctggctatgtctatgaaatagttcattttgaaagatttctatggctagtgaatagttggaggttcgtaaaaagaggtgaggctgaaaggtctttgggtccagttctagaaatgcctggaatgccatgctaagaagtttgcattaaaaagttgttacagatttaaacattttagaaaaagagttctgtaaggaatatgcaatttgggagctgaaggtagttaagttttgaatatgttaatatgcagagggaagtttcctttgtctcatgggatcagattttgtctgtcaaaccaacctgtcttaagggaacttctaaaaacaaaataaaaattgccagcataccttgagtatttattttagtcaaaaacatatgcttctattcagcaatcttttgatgtagagtcatgaccttttttttcttgaagtattgttcagagttgtctttttcacataaccaaaatgtactcatttccagtttctgtttctttcaagtgagaatttaaagatacttgcaaagcaacgtgaatgaagaatccttccagattgtaacatcctttttcctccgtacttaagaattatctcacctttttacctgttcagcggcattttttagcagcttgccttacttattttctttccgtggcattcaccttagttttcacgaggaaaaccaaaacaaattttttttaaaaaactttcatcttgcatgtttatttgcataatattagaagttttttaaaacgtaaagatggaaccgagggtaaaggaaagagtaggtttatggagtgtgacagagactgccagttatccccccaataaccagtgtccttcagcatctgttttctgggcacatggccacacagttagtgactgtatttcctagcctttcttgaagcaaaatgaggccagaagacaagcttctgcctatgaggatgtgaatggaactgatgggtactggtaccacttctggattgtgcccttaaggtgaaaggacacctcctccacttcccgtacttgttttctccctcctgctgactgcagggttcatgtacaggtgggatcatgaacagatatcttacatctgaggtggaagccatctcatgaagatgacagcacaaaaatatatgtcttttatatcttgtctaaatatacttttaaattatgcttagaaacctgttacgtatgttttagtaggattagagtaattaatttggactatagcttagatgtcaagtaaaaaaaagttattttaatttatcctgtacacagcctacctcctcctgagcccctatattctgataagtagggaaaaactagagaatgtcccaaaactgcaaaatgcttaagccttagtcctgtctgataattttaaaagtccacttatatagtgttcagataaaaatgtttcatcacttgccatgctccccttctgctatgctccccaattggtgtgggggacagcaggtgggtgggaagggagggaagagtggcttaaactcattgtagcaggaattgtctgatcgcatagatgtgatgttctgtgcctccctagtctcagaggtgatggcttcctggtattcctggcatcacaaatgaaatatctggtgctataactcatagcttgcttggagcttacctgcttgagttccctctaagtgcagtcctcagtcttttactaagtcttggtcgtctctcctacgctatattggtccatgtaacatcccagtgtctgtcaactcagttaccacactgtctgaaaattagaggtgccttgattgggaaatatcaaccccagaggctctcctgcccaaatgtggtgtggtcatttttagggcccacgttgataaggggcccaacttgggagaaaatgtggggaaggattggaggtaggggttatcaggaaactttggagagttaaaagtaatttgcttcgactaggagtgagatttatgtatatgagtgatgagatgggaagatgggtagatgcaaaggaaattaaagatgattttattcaacttaaatcatagagataccatttttttctaaataaatcgcataattttgatttagtgtaaaaatttggaaattacagaaacattcaagaagtaaaaacacactactccagtataaacacttttttcactcagagatcattgttctgagttttaatttttttaaatttattttttaaacaatatttcttcaatgtaatttttcccttgtacttgtcttttatgaataaacatatgtatatatagctctaaaatacactatatatgcttattttccctctatgaatagtttttgtatcttctgctgtttttttttttttagaatattggtatttttcttgtaagttcattatgtattaaagaaaactatagtttgatactcattaattataaatattttttcctattctgtagtttgcctttatattttatttatggttttactttttttcttcaagtaggttttggggctttttattttattttatgtgttatgtttacatgtttatatatttgtttatatatttaagtctagcctgcttttaaaaaatttgtcagcgtaaaagccaggctcttggatcgcataaaccgaacctgaccatggcttaaggaaggcagatgtttatttctcccatgtcacaaatataagtttaaatagtcttgaggtgctttaccccatgtcattcagggatccaagtactagtagtcagtcattgattcttcactactgtgcacctgtaataaaagaaaaagctaaagaagcaaaaagtattattattttcattaaaccttgagccataaatatatatctctttaatattccatgtgaccaaatgggaaatacacttacagtactcctgtataccaaagcatgatggttggttatcatgagggaaagcagttgtatgaatgtttgagttgtgaactgaactagttcttttcttggaaaaccatttttaattgatagacaaactatggttagtccaccttgggattggcagagttagccattcacttcaaggaaaatagctaacagtatttgttgtcagcaataaaatttgaactttcaagccaaataaaatttttaaaataaaaatatttaaaaacttgttcctgctactggcatctcggcgtcttcacaagactgaaatccttttctgaggagattatgagtaattttgaaaaggaaattaaaaaatatatatgtgtatatttatgtgtgtgtgtgtgtgtgtgtataaaaataatgaaagacatcaacatttggtcctgcaaaacttaaccaatttccaaatcaaacatgggttaaagattcattccaagtacaagatagaccgatggatttaatgtacaggcataccttgtattattgttcttcacttgattgtactttgcagatactgcctttttttttttttttttaacaaattgaaggtttgtggccaccctgcatccagcaagtctgtcaacaccatttttctaatatgtgtgctcattttgtatctctgtgtcacattttggtagttcttacaatatttcagatgtgatctgggatcagtgatctttgatgttactattctaattgttttagagtgccataaactctgcccacataagacaaagaacttaataaatatatgtgttctcattgcttcactggactggctgttctctcatatctctacctctcctcaaacctccctatttcctgagacacaggaatattgaaattaggcttattactaaccctgcagagtggcctctaagtgttcaaaggaaaggaagagtcacaagtctctcagtttaagtcaaaagctagaaatgattaagcttagtgaggaagtcatgtccaaagataggctaaatgctagtgctgttgcacctgagataggctgaatgctagtcctcttgcaccaaacatttagccaagttgtgaatgtaaaggaaaagttcttgaaggaaattaaaagtgctactgcaatggacacacgaatgataaagtgaaacagccttattgctgacatggagaaagttttagtggtctggatagaaaatcaaactagccacaacattcccttaagccaaagcctaagccgtatctaggccctacctcttccgttccgtgaaggttgagagaagtgaggaagctgcaggttcaggagcttgaaggaaagaagccatctccataaaataaaagtgcaaggtaaagcagcaagtgctgatgtagaagcagcagcaggttatccggaagatctagctaagatcgttgatgaagatgactacactaaacaacagattttcaatgtaggcaaaacagccttctatttgaagaaagtctcatctaggacattcatagctagagaggaaaagtcagtgcctggcttcagagctacaaaggacagacttactctcttgttaggggctaatgcagctggtgactgctgaagtcagtgctcatttagcattctgtatatcctagagcccttaagaattatactaactcttggccaggtgtggtggctcacgcctgtaatgccagcacttttgggaggccaaggcgggcagatcacctgaggtcaggagttcgagaccagcctggccaacatggtgaaacccccatctctactaaaaatataaaaattagccaggggtggtgacaggggctgtaatcccagctactcgggaggctgaggcaggagaatctcttgaacccaggaggctgaggctgcagtgagctgagatcacgccaccgcactctagcctgggcgacaaggggagactctgtctcaaaaaaaaaaaaaaaaaaaaaattatactaagtctgctgtgcctgtgctctgtaaatggaagaacaaaagcatggatgacagcatatcttttttttttttttttttttttttgagatggagttttgctctgtcgcccaggctggagtgtagtggcacaatcttggctcactgcaagctccgcctcccgggttcatgccattctcctgcctctgcctcccgagtagctgggactacaggcacccaccaccatgccctgttaactttttgtatttttagtagagacggggtttcaccgtgttagccaggatggtcttgatctcctcaccttgtgatccacccgcctcagcctcccaaagtgctgggattacaggcatgagccaccgcgcccggccagcgtatctttttagagcgtggttttcctaatatcttaagcccagtgttaagaccttactgcacatatataaagattcttttcaatatatttctgctctttcacaatgcaccgcattatccaagagcactgatggagaggtacaaggaatttgttgttgttgctgtttttagagacaagatcttgctctgttaccaggatggagtgctgtggcatggtcatagtttactgcagcctttgactcctgagctcaggtgattctccctccatagcctcccatgtagctaggactacaaaatgcctggccagtgttttttattcttattttttgtagagttgggggtcttgtaatgttgtccagattggtcttgtactcatggcctgaagctattctcctgacttggcctcccaaggggattataggtttgagccactgtgcccagcctaatgttgtttttacgccttctaacacagtatttgttctgcagcttatgatcaggaagtaatttcaactttcatgtgttattatgtgagaaacacattttgtgaggctatagctgccattagatagtgattcctttaatagatctgagtaaagtaaattgaaaaccttctgaaaaggattaatcattctagatgccatgaaaaacatttgtgattcatgggaagagaccagaatattaacattaacaggcatttgaaagaatgcctgggttgattctaaccctcatgaatgactttgaggggtttgggacttcagtagaggaagaagctgcagatgtggtggaaataacaagagaactagaattagaagtggagcctgaagatgtgaatgcaatatcatgataaaactttaaggaaagaggaattgcttcttgtagatgaacaaagaaaatggtttcttgagatggagtcttttcctggtgaagatgctgtgaacattgttgaaatgacaacaaaggatttagaatcttaaataaacttagttgataaagcagtggcagggttttagaggattggatccaattttgaaagaagttctgctgcgggtaaagtgttactcaaagagcatcacatgctgcagaaaaatctttcttgaaaggtagagtcagtcagtgcagcagacttcattattgtattttaagaaattgccacagccaccctcaactttcaccaacactaccctgatcagttggcagccatcaccatggaggcaggacccttctccagcagaagatgatgactcgctgaagggtcagatgattgttaacattttttagtaataaagtattttttattaaggtatgtacattttttagacatcatgctattgcatagttaatatagactatggtagagtgtgaacataattgttatatgcactgggaaaccaaaaaattgatatgaattgatttattgcaatattctctttactgcagtggttttgaatagaacccgtaatatctctgaggtatacctgtacaaaaataagaaaacttcatagaaatcgtttcagattctacactgtaatcaaactttaagaagttaccacttctcaaattacgatgtagaataagactatccataattatacttaaatgttattgaatgatccacccttttctaactaaagtatgtgaaaatggattttcttcttatatttcaacaaaagtgtaatgtattacagtatattaaatgcaggaatagatatgagaatccagctgccttttattgtgctatttgtagaaatgcaaaacagtgctacttgtcttactattttggggagggaagggaaaatataattattccattaaaatagtgtattcctttttaataactagttagcaacttaatgactgtgttatgataactaatcaagaaaaaaggaggtgacctttttcttctttttcttcttagtggctctccatctttagcatgcatcagaatcacttggaggaattgttaaaacacagattactggacgcctcacctccagagtttctttctgattcagtaaacgctggatggggcctgagatgtccatttctaaccaaatcctcaggtcatgcagatactgccatcatagcttcagaaccactgttctacgtatttctttggcttattaggcaaacttgttttacctgccatttgggaaggaaaaatactagaattttaaaaagacatgtagttcaggtataaagatgctggaagtgtagtatccttagttgccagaaatttgggaattaattaaaaattaagcagaacagtttgtcagaaattattcagtgtctgagactttcccctacgtacaagctaacaatttaccatatcaccatttcataaatactgtgaaaagacctgaaattcctgggttagagacaaaaagttactttaatacagcagttatgccagagaatcagcactggtggtgatttacccagtccataagggcagcctgaacagtgccaggtgataggtgcacaagaagtgggttatgttatagtagaggaaccctgaccttagggatcacaattttttaaaaataagtcagtgtctgacctctgtcccagaggatatattacctttattatactggacagtaaacctattttttgccgtagaaggagacattatctgtatcttcttgtctctgcaaatatccttgaaaagataggaataggtagtctgtgactccgctcacaaatgtgagagaggcccatgaagaattgcagcttggcataggaaatgttgaaaaagtttgtatatgttaattatttgccagtccttaatagaaaacagcttagcaaaaacatgagcgcaattagacttgagctttagacaaagcagtatatgatttcctgatgaagaaaaacatcctcttcctgtgtggttctaaattattttcataaatgtgtatgtataattgtcataggaagtaaaatttcttacccttataggtcttacatgaactataaaacagaacattcttataaagtgtgtgtgtgtgtgtgtgtgtgtgtgtatataaagtgtaaatgtgaagttagtataagaagtaatggtatgttagccacaataaattgcacttgcgatatgattcttttgatttggcatacctcttctgcaaagggctgtataatgtcaaattttcccacatctttttctacctaaaattctgtagctttcttttgtgcagcatgcagtgtttatttggccttcacttggtacagatgcctcattaacctcctttgtttttccctcattagctcaagataattaaagtattactacttggcacaggggtagtcaagactctttgggtcagtgtgacagaaagcaacctcatacctggctctcatagctgggaaatcaaggtggatttgtctgcagttacgactagagtgatatatttcctgcttggcccaggtcagtccagttgagcttgtgtccactttaactctcaaaagtccctactttgaagataaattatatgttctcctgactgggcttcatgtaaaggttcaaacagtactgtcaggcctctcatgtcctggtcttcattcagtgatgctctcctaggttttggcccatcctttaagggcatcctccattatgtgatcattgaaaatggcttttgtgggccagatttcacataccttttcagtgctgtaatctttcttgatagctttcatataaaagggaagggaaagaccagctcattcctttgtgggaggaaaaaaaaatcactgtatcttaagtgattgttttgtaagtttttatatatatatattacatgtatatatcttatattgtaaaatttttgtttgctggtttatctataagcataaggaattttattcccaatgacaccactctcatgggccacttggaaacacatgacacttcttctttgaccagttgggtgactgacagtcaaaccagatagagtggtagatggaaaggtccctccagcacaacatttaacatttgcttaagtatcttagggacttataaacacaaactcaaatatagaccttgaaactgtatgacacccttcaaacatatggtgtgattagagtgacttagagtttatcactatacaaataaaaacactgtattaaaatgttttgcagaaaacgtacacctgaaaatatgcctgtggcctctggtcctccacccttcctcatcgagtgggtgtgtagattcaaattttagaaacattttgtctgtcagttcagttagccgaatggtctatttgacgggcatctcagaaaagagcttccagtgctgcacacaattctttcttttgtcctgcctttctagggtagctttgtgtgtgcattcattcatttttttaaaaccacataaatgtattctttcatgcttctgcagctaaatgttcaaaatcaaagtgacagtggggttgcctcctttgatacataaaaattatatatatttacagtatacaagctgatgttttactatatgggtacgtaaataattaagtcaggctaattaacgtatccatcatcttgcatacataccattttttgtggtgaaaacatttaagatctactctgttagtagttttcaagtatacaatatgttgttattaactgttgtcaccatgatgtacagtggatctctacaacttattcatcgtaactaaaacttggtaccctttgacccacatctccctccctccccttcagtttccccagctaatcctcctggtaatcacagttctatgctgtttctatgagtctgactttttttagattctacatgtactatacaagttagattatgtggtatttgcccaggtttatccatactatcacgaatgacaggatttcctttttaaggctgaataatatttcattgtgtatatatacacaacattttcttcattcatctcttgacagataatttagattgattgcataagttggctattgtgaataatgctgcagtgaacatatctcatcaatatactgatttcatttcctttgtgtgcatacattcttgctcattgtaatagtatgatacctatctcagaagtgaatggctcaggggatagttttatatggagttaagattggggaaagtgggtcattttgaagctgtggattttggatttgaacgtttacagtcattattaaattcttcttatattccagaatgtcagatatctcccatgtatgtgtaaatatttatttaaatataagttcagagcttcttagaactaaatggaaaagattttagataattacctttgttggggaatgataattaaaaacaaaatctcccaacccaggaatcctctttacaaaaatagcacagaaagaaaatattttcattattaaataagcattaaaccagattgtgatgtacatctaagagattgaaaagacaaaagaccctcacccctttatacattacagcctattcaacccattacatgcatgttcacgtgacaaacagtaagtcctcaagtaagaagacttcaaagcacctttgtcacacatagcttaccctacctttactgtggtaattgggatgaccatcatgttagctaattggcctcattcataggagaaaaagaaacttctatctttaggacagaagttagttttacatcttggagcaaggtgcccatgaagtcaagttcctaccctgccacagaaactgggaggcaggatgctatctcccttgatatttacatttcaaagagatggctcccaggtccttgagaaagacattcctgagtcataaagctggcagaaggcctattttgttttcaaaagaatatattatatacatttcaaagaaagagaaacgtatttccaattataatttttctaaagtaaatgctctaagaaaaagggagggaaatgtttttcatttcaacagggagaattgaacgttttatttttaatttatatttgcccttgcacccctactttatctacttctgtcttaaatataaggaccttgatcttattaatcttacagtagcattataataaagagaaaggattttaaatgcatttataatttagttttagttcattgtagtttagttttattcagtgttaacattttaaatcagtaaattcaacataaaaattaagatttcttaaaaggagagtagaggtatgaggacttcagcataagataacttggctaaatccccatgttgtagctgaacagcctgtgatgttggacaccctccatccttgaagccaggaaataaatgatataaatgtgaccctaagcaaaagttgaccaaaggatttttttctttgaaagaaaaaaaaaaagatacttgttttctgaggtcagaagtgtttttttgttttaaactttaccagcagataaaactaaaatttcctatgctacccccaaccaaatcagaggcagacactgtttgactatcacattgatagcgataaattacataactctcttaaaggaattagaatctagcaaagggttaccttatatcttgatttgtttttattttttctcccttcctcccaccgtcttgacttgatgcatttccctttcctggatcctaccggtaggctgctgtatgtttgagaccccaaaatgcctgtgagttctctctccggtgttaatgtgatggtgctcctttgtcctcagcacagtcttatttgctgggctccatatttgctgtcagagatgcagtttttcgttagccacttcctccttaaaggagaccagtgggcggagggggaggactcctctgtgtgcctgttaccagtagcgaatctgatgcatctgcagcaacctcaattcttacctcctcagaagaaagaattcggccgaggggcataaggtagggagaccgagaagttttagaggagtgaaaatttattaaaaagttttagagcaggaacagaaggaaggaacgcgcacctggaagagggccaagctggtgactcgaacggttattgtgcagtttggccttttgacttgaggttttatacattggtacgtccagggtcttgtgtcccttctcccctgattcttcccttggggtgggctgttcacatgcgcagtggcctgctagcgcttgggagaggagcctgtgcagtgtgcttactggagttgtgcccatactcacttgaggcattcttcccttaccagtctagcattcctagaggaaggtcatataccagttaaactccaccattttgcctcttaatgtgcatgcttgagctcactcacccatctcttcagatcttattgggaagctgctgatcaccagttgcaggtttttttctatctatatggagactgcctttccctttcactggctgtgaccaattactattttagagaaacatttaacaacctcctgtccatcacctgatggtcacctgacattcctggtcaggtggaaccctctcctgccctgctcatgcctgactagctacctactataacatcacaactttggctttatcgccactggccaaccataaccattgcacacatattctcagccctctgggagtcacattcttccctctaaactctcattcactccacagtgattagttgactgatagttcctgtgccggccacttagtcaccttgaccagccaggtttcgtgactgcaaatggtcacgcactttgatctttcttgactgacacatgttacatatttctcttttcttcttgaagttgctcttggtagatgggagcacttttcatcccatcctggatttaagtgaaaagtaacagcaacttggctgagtactactggaaaaaatttaccccccaaccccatttttttctttacaatattgtttcctgctgaagccatgttcacagggttaaaaagaattctagacagaaatatagctataattaagcattattcagtctgtgctttgacccacttccttgtaactgaaagtcacataacactggatactgaccatttgcatcctggttgttcctatagatagtatttctggccttagattggatctctggtgttagaatcatgaggcttttgtttaagaattgtttaagtagatcctgaattccaatttaacagctgaggccatccagtttaaagaccctcacagaagaaccgaatcagcctaagaatagtttcttcatttccctgtcctatggctttaccctgcattcgttgaccgttcaatctgtacacttcaacccactccaaaacccctaaaaacgctagccccaaactcctcaggcagatagatttgcggtttcctctatctctgttcggtggccctactacgattaaacttctttctctgctgcagcccagggtctcagcatattgacttggcatgcacatcaggcaacgatgtgcagcgttacactcccagcctcccagaagtgactgtgctgcctgagatttgtagagaacaactatttactctttcctgtatgctatatggagaaaataccagtgttcagaatgttgaaaccctaaccacgtggcatttgtaattttcctcttaggagactctgtatggaattgagagttgaaaactaattatgtaaattgctaagctttgaaacgtttttgcaaaatttctgcctgtagatatctattccacaaagagtattttgtgactagtaaagaaagtacaaatccagttaataagactgccatccgcactctttttttttttttttttttttttttttgagacggagtctcactctgttgcccaggctggagtgcagcggcacaatctccgttcactgcaacctctgcctcccgggttcaagcagctcttctgcctcagcctcccgagtagctgggtctataggcacctaccaccacgcccagttaatttttgtatttttagtagagacaggatttcaccatattggccaggctggtctagaactcttgtcctcgtgatctgcccgcctcagcctcccaaagtgctgggattacaggcatgagccaccgtgcctggccccccactctttaatgttaaacagatttcaggactttttgaaccacaagccattgactggatgtgcaatgcaaagtaagctaagcgtcccatgttcccatttatttgaagagataaaaagttaattagaatgtagagataatatctaatagcaggaaaatttgtttttttttcttaaggtttaaacattctcatttgtacatacatagttcaactggaaaaatcttattctttactatttctgattttcttcctttcgtggatctcaaaactcacgagcttacatcacttgaacctttctctgggcttttcagttgtttcactaacaaaatggaccatagtggctattcatcaaagttcactatatctgtggtatcaccatccctgtgtacgaatcctgggatctagagtgtcccatcatcacagcatggcaaccactgcctcaactcacagtactctagaaacccagagtggtttattaaagacagccccactggaaactgcctaggttatattgcttgggtggaccccctggattagagaaatgtgtgagccagaatgcctgccattatgcttttcatggagccaagcacactgttgttgattaataaataatgggttgtttatcttggaattgttttcattggcagatgccctgaaagattcaaaggctgtctgtaaatggagaatgcctttattgtttattcagtgcctgcctgcttttctattcagtgtgagggtattttgggaaaatttcttacatatcaaaccacaagtaaaatttagggagttttatcctcagattttcaaatagggcatttaactatgacctcttttcagatgcctctgatgatttgggtgtgtgtgtgtgtgtgtgtctttgtgtgtgtgtgtgtgtgtgtgtgtgtgtgtctttgtgtgtctggagagggaaagaggtaaagggagagatgaggcccagaagttgaccatcagttgtatcagtcagaaatagcttaaataaattcaagtacatttctggttggttgattttgtgtatagcacaagctagcttctgagaattcaaatacaaacatgtgcaaagtgagaggcagcaggaatcacatgcagagtgggtaaggagaggttgacaaaggaggtaagttcgatgcttaataaaaaatcaccagggtggcaagaccagagcaaattgcattttggcaggggaaacagtgtttgaagatgtgtggcatgagcagcagtgggtgttcctggaactgtaagttgttcagtaatgctgaacatgaaactctgtaggaatggcccagggaaaatgggaatatggagcctaaaatgaaatgaaaatatagtgaaaatcctgggcccggtgtctcaaacagtcataaattcctccaggatattgtagtattggccaaagagtatgtgaagccaaatgatagacttgtcatatcttccatgtcttgtgtcctttgctcagatgttctcaatacccagcaatcaagggaggggagcctgacaaataattgatctaatttggtataaagatagcagctattgttaagtggaaagggtatttaagaagggcctgattttgtaaactgtcatttccttagtagtattttcatgttagggtagcatagcactaggaactcaaatcttgaggagagcctgcatgtatacagagtgaaggagagttctgagaatggctcctggccttatggcttgcataacaatgaagatgaaaaaacactttttattttatttttgtccagcacaacactgaaccctcagtgctagcaagtcatgttagttctgtattaggtttttaataatggtgatcgaacacatattccatgagacatagctgtttgaacatctgatattttaaaatagtttttcatgtggcttcttggtgccactgctgcctatttcacaagagccacaggttaaaattaagataattggtcaggcagttaaaacatcttccaatggagagcagagtcttaaataaaactaatttatacaggtttaatttaacttagagaagactgaattttttaatgctttggagaatacacacaaacaacagtagaagcatgtttttttatttgagttgattgactttaagtatatgaaataataggtagagcagacttatttcccagaacttttctgtgtgtttagaaaccgatgaagctcattttatttatttgttttaaagtaaattttaaatgcatacaacatgatattacaaaatatatgtatcaaaatggttaccatattgggacaaatgaacatatacatcatttcatgtaattacctgtttgtcccctgtggctagaacagctgtcatctactcatttagcaaaatcctgactccatacagtattattactgtacaactacagttctcatgttgtatgttagatctttatacttattcatcctacatatttgctgccttgtatctcattttagtataaaacaaaattcagctctaagaggtagacacacagagagagactgggtgtgtgtgtgtgtgtgtgtgtttgtgtgttgggagttgaatatacttaagtgattatgatgaaattagaaaccttttatgttttatatttttaggtgctggtgaatctggtaaaagtacaattgtgaagcagatgaagtaagtagatttaaacaccaaatttgctgtttaagttagtgtaccgttctaccaaaggaagtaaataattcttttttttcccttttgtctcattagaattatccatgaagctggttattcagaagaggagtgtaaacaatacaaagcagtggtctacagtaacaccatccagtcaattattgctatcattagggctatggggaggttgaagatagactttggtgactcagcccgggcggtaagttattaaatttgttggagctgacctgatgggtaaaaagaataacttgtatgctaataccatactgtgtaacataggcttgtcaactatcaggaccatttcataaaaggaaccaaaaggatagaagtgagtgaaatgaggagcgttagaagtgagtgaaatattagaatatgtaggattgtataatctctcctttatgctttccttatccattagatgatttggacaactgaataatcaccacagtgctttctgtgtagcatgctgtgttgggtacccctgtattcccataataatttttagtactgagtaaactgcttaccctggccctcttcaaaatctgtttctgcaatttggaatactgaagtgatctagtcatttgtattcatgcctagactgaaaagcaatctaatctcgaataatgaaaacagtataaaagtttgcttatctttggaataggaaaatatcggctattaaaaaccatgtatcaaaatttgagagctaaaagagatttttggagacaagctagtttcaattctttattttgccaagaaagaaactagcacccaggaaattacatggtacagagattgccatacagctcgtggtaaccaaggcactatgcctgtgcctcctcatttggcccaataacttgtttcagttggattggaagcagcccaatccaatccgtaaggcacctttgttttctttttttttctcttatcttctctttgattgcttaatgtatttatttctagcagatatattattgtattatttttactagtatttatttttatggttcctttataattctgtatattcagtatacatactgtcttcctactaatactatgaagattttgtgtatagagactataaatttttctttttgtcttagtgtcagctagattttattttttaaacatgtaggctcaattcatgcttactagggaagaaaaatgaatgaaagcaatattagggaatatacattggaaaaatctgtaaaatctagtttttaaaatgttactttaagaattctcttacaagttactgagctatattaatttactgttttttaaacttttttaaaaagcttactgtcattaattaaaaatttcaagtagatttcaatatcattttaaataatttatacatttatcatttattcagcaaactttttgagctcaaaaagcatttgttgaatgaataaatgataaatgcataaattagagtgatttccaagcaataagcattcttgagatgatcaaatcttatttcagaaaagacattttaaaagaacattataaattattattgaaaataatgttgaaatctacttggaaatgctaattaaactaagcctttttaatctttgtttaaaagactgcacagtagggaaccatgcttagattaagaaaaaagaattaataaaaattgtaccttacaccaattctaattataaacttttaatttaaaccttttgccaaattcacatatatgacattctgcatttggatcttttatgtgcttacgaaagaaaaaagcgttgtagcctccattttaggagatcatgaagggtcaatacaaacagtttttcatgagttctttttattttcaagtttttctctcaaggaatgttgtcgttttctctttctttttttaaacataacttgggcgtagtttcaagactggaaataactactctcaagctctatttttttttttaaaccagttttctgatgctttggaatcttatgtgggcctgctttgctcatctttgtttcactattgctggtttgacccactctttttagactgtctttagcgatacttcagtaactgtcttcttcctgcctttagactattacttctgtttgctttctccatcatcattaactcattcacacaaatgcctcatgtcctcccattgcttctcgttggtctactccgtgttttgtgttacctatctttacgtaagctttcaaaactactgggcttttgcagttgtgctaaggaatacaaagacgaattaaacgtggcctggacacgaggaaggggcattgaaactgagtgttgaaacatgaataagagttttctggacaaaaatggaaaaagcgttgtatgaataagaaacattttattattattattatatttattgttgttattattttgagacagtctcgctctgtagcccaggctggagtacagtggtgcaatctcagctcactgcaacctctgcttcccaggttcaagcaattctcatgcctcagcctcccaagtagctggaaccacggatgtatgccaccacacctggctaatttttgtatttttagtaaagatggggtttcactgtgttggctagactggtctcgagctcctggcctcaagtaatccgcccacctcggcctcccaaagtgctaggattacaagcgtgagccaccacgccaagccacaaacagtatattcaaaagaagtctgaatatatttctatttctggaagtattaaccctgagttgaaggataaccagatactgaattttgataggtaccacaggtttgctttctgaagaaaagcaacatgaataatctgttttagtatccgttcataagtgtctgttttaccatagtctcaacaacttaggtgttatcaacatttcagtttttaacatctgataaatcagaagtattgtctttttctagtttttttctgatttttaatgaatttgagaattattttaaaacattttgttcatttatatttcttctgtgaactcctcttagttttcactcatttctgttcaattacttaccttttcacattgattctgtttaagtattaagcatattaatccttccttgcatattgcaaacacttttgcctagcatatttcttttagtttttgaaatagtacattacagaactgttaagatttttacaatcgattctcacttctgtgttttgtttcttattagaatggcattcttcaccttataattttttaaattctcttatttttttagaatgtttgtagttttattttttatatttatctctgtctcttcacacacctttaaatgttgtgtttgttgctagttaggatctaagtatattttataatatcttttgcctaacagtcatttgttaaatattaaataatcagcctattccgtctattcctcagtgacttgaaattgctgcccttagcattaaattgggtgtgtttctggactccagtttttctttctattgatgtgttctttttccccacatctgtcacttactaagctattcaacctccctaagcttgtttccttataatacaagggaaataatatctatgttgtagggttgtgaggaataatgacattttgaatattaagcactccccacatgccttggttataatacaggctcaataaatgtctgttgctgctattgttatcttttggttttttttctgtttgttttttttgaaatggagttttgctcttgttgccaggcttcagtgcaggagcatgatctcagctcactgcaacctccgccttcctggttcagcgattctcctgcctcagcctcccgagtagctaggattgcaggtgtccaccaccaccacacctggctgattttttgtatttttagtagagacggggtttcaccttgttggccaggctggtctcgatctcctgacctcaggcgatccacctgcctcagcctcccaaagtgctgggattataggcatgaggcaccgcacccggccttgttttattgtttttttttttgtttttaataattattattacattactgtcattctactgagagtcacatcattttaatttctatggcttcatggattagttggcacctggtagagtaagcgcaccccgtttcattccgttgttcttttgccgaatatcaaggccatcatggttttctctgccagatgaacttgagagccagcttaattcccccacaaccctgttgaaacacaacaaaccaaaacagcttgttgacttggttgggattacatcttacttagtatataggttgatttggtaagaattgagtaagaagatgtaaaatcttaataagtgttgactaattttctgtggtttgcttcatatttggcagttaccagattttcaaaacagattaaagactggttatttaaaatgagaagaaataaaattgttttcaaggcttgcatagagcagtcacattttatgcctaatatcatttcacagctttcgtagaatgaggatagtccatctgcgagtgataatatattgataatttaggtgattatgtttctaatgaagtaaaattttagaagctttacaaaggggcctattcacctgttcaggcactgagcacttagaggagagctgttcaaaatgtgattcatggacttgtggactagtgcctgtccacaagagtgtgcacaaaatggatatagaaattaaatgtaagcattgggtttacagcaattgacagagtaatttatatgttcactctgagagtttttaaaatattaatttatattttgtgtgtcatttaattttttctactattattctggaatagactggaaacaaatgcaaatgaaataaaacacaacaccggttcttcatcacagatagcttgagaagcacttatttagaatataggctgtgaggagtgggaaacctcaccttgaattgacttaaataagttttccccctaagcctcatacatgctcctgcataatggccatttttctgttccaataactttgttatttactttcattagttagtttgtctgtgtctgtctgccggatttgctagattgtcttttagaaaggttctatcagtttaccttccttgcagcagtttttggaatgccttttcttagcactctgggcagccaaaatttaggagtcttgtatttaaaaaatctttgctaatttgttgttagtaaatcatgtatcagtttaatttgaattttccatttttaatgtagctgaacagttttccctgtctattgattatatttttatttttctatgtggcttgtgcactttattcatttaccacttggaatcttggtgttttgatgatctgtttgcttgtttatatgtgtgtatgtattaactctttgtccattaatacaaatgtttagtaagtcaaattttacttaactgccattaatgttatggtaatattgtattttaaaaaatgtttaaaattcccgttatttcttccattgtgtttaaatgtagaacatcctctctcaacaaaagatttaccaaatattgatgctctttttaaagcaaggggaattttgagggagtgaattttaacatttgtttctgtgtttattttttaatctgtctgaagcatgttttgttatatgcatggagtaaggatgcacattattttatttctcttcaggtggctatctaattatcaccagtgttattggattaatcgtatcttttctgactgatgtatcttgccacatttatcatgtaataagttcagatttgggatttttttcccctatggatctgccttcatagtagactgtttctacatattgtaggcttttaatatctgataataacatccctgtgctcccagtctttttcaaaatgctccttgttacttttacttgctttttccacatgaatgtttgaatcatttatagtagtattctggtttatgtttgagaactaagatgaaaatacggtttttgttttgattctgaaaaatattgatatatatgtggcaaaatgatactagccaccatttgaaatgaatgtgtgcttctaatacagtatttttctatcctcatttcacttatctcacatttctgtattgacaagttctcttgtcaataccaggaacacttaaatgtcaatatttctccattttaccaatttgaaaaaatatatctatacatgtataagatttataaatttgtatatttatataatatgtttattgataatttcccttcttgacttagtgaaactcatacttcatgctaaattcactgcaatttggttaaaaatttatctctgcaatttagttaaaattaactttttattttaggctttttccccccttttaagtattcttatggggaaaaaagaaaaatgacttcctatttcatttcctcaagacatttttactttgattatatttctgcttttagaaaaaaaaatgtattttacatgtatgtattccttaaagcaactcttcaacatctgatcaagtcggcttcatccctgggatgcaagactggttcaacatacgcaaatcaataaacataatccatcacataaacagaaccaatgacaaaaaacacatgattatctcaataggtgaaagaaaggccttcaataaaattcaacagcccttcatgctaaaaactctcaataacactccattaccatattatttagcttctattttagaagggcttgcagatctttttaaatttaaactcttaatctcatacataaattctatctgctgtattacaatagtcatctgacctttgctttaaaaactctgtcattccccttcccttttttgtttttcaggtggctttgattattttaaaaaaaattcctctagttgagatgaactctgatatcttttgctctaagaatgctcctttttctgctctgtgcctaaacatgaactctgttctttcttacctttaattatgtcagatgacagccatcatgctcccttaaagtcttctcctcccatcctaggcagactcttctgaattttcatcaagtgggtgacagctttaaataaaacatgtaatcactaaataagtacagcatgccagatatcccctgaccaccgcttggaatgaggacttattatttgtctctttgacaaaatagtgcttcatagctcctttctgagttctcagagcacatgaatatatgaactggaatttactttctctaaatcaacttatttttgtttagcttttagtaatttgaaaatattttagctttgctacatgcaaggaatttttctgtcaaataattgcctggcaaataatctttcttttcaccaccacaaagacttcctgtaaactgctttattaacctgttaaccctccttaccaaactccagtcttctcttaagtaatccctattctttttctactctgtatcacactattttggtacacttacatttatatttatagatgttaagtaattttctttctcacaaattttgcaaagacctcattccatggcaagataaaatcgttgtcatcattctgtgcttttaaaatttatcctattttagataatgaatcattgactccctaatttgtatgattgggtgactagccatggaactttaagtaagttgcttaacctctttgtgccttgggttcgttttatacagaagattaggtagaataatttcagcagtgttttcctggtcagatttattgcctgaaagctcatctacagacacacctgaatgtcctggtaatgatgtggaagtgaataatcccagtaaattttttttaaagaaaagaggcttgaaaaaattatctgagctttacaacttgatgttatgagatacatatagatagtaaaattgttactatagtagagtaggttaacatgcccattatctcacatagttaatttttttgactagaagagcagttaaaacctgtttaacaaaaatctcgaatacagtactttttaattagctacagtcctcatattgtacttcagtctggacttctgtagacttggtcatcccatgtatctgctactttgtattctttcaatatgtctctctattttctctttcctctccctcctctcctcccccaccccataaccataactactggtttgttctctagctttgtatatttgaccttgacctatttttgtttctgtggattttttttttttttttggagacctggaggacattatgcttagtgaaataagccagacacagaaagaaaaataaaacatcatctcacttatatgtagaattatgaaaaagaaacattttttaatgccacagagagaatgtgatttataaatacagcttccaaagtttcttaagtctttacttcaggcctattcctggaaagtttgagaagaatgtgatcttgtgacccatactggagggcattagtctttttttgtcaaaaaacgctattgaaattgaatgaagacgtcgtaatgaaagctcatttgaaaacctacttaagcgaagagtacttttctaaaatagaaaggttatatttgatgtaatttaataaataaaaatggtcaaattcagaaatttctcatgtataggtaataatttggataattgaataattgtttactggaattagactaatggtgcaaaaatgactggaaaccatgttatgtgaggtttattaaggatatcatgcacgtgtcgcttgcatgcatttctcttgtgatttgctaaaaagggaagcatatgcttgaataatatgttctcatgctgagagacttaattatttttcatgatgggttccagctgaaaagaaaatgtttcacaaattggcaacagcatgaatttatattgtcagctagtacactctgctagcctgtgtcaccaaatgctgcttctcttctataccccttataataatgtgtgccatcactttataagcatctgctacaatactttggaagaatgcctcttgaaagaaattaggaattgtccacccagttatcttaaagctacatatctcaagttaaggagaatctctgtgaagaaagaaacttcatatctgggttttttgtttgtttattgttttgttttttttttaattgtgttattacttggaaactagagttaggttatccagtatggtagctactatccgcatgtggctactgaatccttaaaatgtatctactttgaattgaaatgggctgtatgcataaaatacacaccagatgttgtaatacgtatgaaaaaatatgaaatataattgtgtatttattacatataaatgaattgatatttttatacataggttaagtatactgttaaaaatcatttcacctagctttaaaaaaagcttttaaaaaatgtagctattagaatatttagattgtattagtgttgcacattatatttctcttggtccacacactgatttagagtggttgattacttgtggatcagaataaccaaatatgagtagcctcaaattttaagctaagtttaattaactttatataaagtatcttttcatttagaaatttttacatactgtcctctatgtatatcatgagtatttctactccaaagctgtgcttattttgttttctatgcctggattagcaaaacacctgctcccaacttctgccccattgattttaatgtgtccatacttaaaatctcctgaaaatctcagaccattacatgaaattagtcttctggtcttgcccactccacattgatttctcccttctctgaacttactttgcaactataaggtatatcagaaagctaacacttaattcaattctatctctaatctttgaaagttatgtttcttagtttagaaaacattttgaggagagaggaagaagacataggttcttcttctgttttctcaaaaatgatcatcttcaatacacaacaaactgtcagtggataattggctaatgtcccctttatgagctggaaccttaattattcttccagcttcctagtgccttgacagatactactaacaccacaaaacatagacatatgatgtgtgattattgtcttttggtcaaggcaatttttaagtggtggcttagagaaagaaaagtaatgacgtgttaataaaaacaaaggaagttcgctattgcctttttttttttaactctagaattgtctcctttgtactttttatctctgacgtatccctttttacttaaaaaatgtcctttgaatgttcaggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatagtaagtaatcataacttcagaactaaactatcatgaataattacttgcaagtcaaatatacttccaagtcaattttactgcagaattggctgacacattcttgtacaacttaggatattcaggatgacaatattttaaaactttgtcttatgtgtgttgtgtgtgtgtagatagcaacgttatttcctatatgttcaatagtgtctcaagagactcatgctatgtaactctaattgaaacatggagaatggtacctgttgcaatatattttcaagaaagtaactggaactttccaaaatccactccaaattggggtgtatttctagtttacttggagctatgttaatgagagtgtaactgatttgagttcctttcattatgttagcagtgcctgagaagagttacttgtccaatgacaggtactgtaagtagggattttttgaaggagtgcaagatgactccaaggtattttttgactaagtaaaatagctctgtatttgaaaattgtcagttgtgtgtgtgccctgttgtatttgacactgtttccagatatttaagtacagttttttggaagaaaaatctgccttgaattttcaggtggtggccccagaaagtttgcaaagcaagttgtgatgaaacctaatcagggaggctgggtgaggtggctcattgcttgtaatcccagcactttgggaggctaaggtgggcagatcacttgagcccaggtgtttgagacccatctgggtaacttaacgagacctccccccaccatctctacaaaaaatacaaaaattagccagtcatgatggtgcacacgtgtggtcccagttactcagcgggggctgagagaggatgattgcttgaacccaggactttgagtttgcagtgagccatgctcgtaccactgcactccagcctggagatggagtgaggccatgtctcaaaaaaaaaaaaaaaaaaaaaaacctaatcagggagctttctgtttggtgatctccatagaacaacaccaaaacaaaaaaaaaatttataatttgccacacatactcaaaatgtcctatatgatatgtattgctcttaaaacctatgttgtgcatttgttttactttccaggattgttccattttcttgacacagctgttggctgttagggacacaaggattagatagatgacaaattttgaaaggtctaggtgaatgcatgcactttgccacaatgaataaataaatgaggtgtgcctcctgaagagcgaattatttgttcagcatcagactaggtactatatgttgtgtgatttagtgtgtttaagaaataatgaatattgtatcacccacatcaatctttataaccctgtatttcataatctatatttttaacattttacacttgtattaaccatatgtattattacgtggtttatacatgtatatataacataaacatattgaatatgtagcccatctctccaactggtatcatatcctatacaaagaaatattccttgacccactgagttggtccttgcgctccagttttaggtactcctaatgtactttttcttcagctttacatttattttgaggttattttgttcctgtttatgttgtgaatatttgattattttctgtctctgccattacattgtaaattcagtaatgtgtttttacctaatattgtattcccatagcctgacacagtcatcacccaatatgatcttgtttaataatgaatgaattcataaaccagacatcacagaggctagaagacaaattagaaaaaatacttacaggaagaacacaactcataaaccatatttgctttgacaccaccagcatctgtggagatttaagtgggagtcactatgatgagaagattgctttgagtcgagtccagcaaaaggagctacttcaataattaaggggtactacttgggaatgacagattgaagttctctttctcactgtatgggggaacttccagaccccctcagtctcttgtccaagaccctctctcctgtgcacactacttggacgtgagttaacagaaacataggccgggcattggtggctcatgctttgtaatcccagcattttgggaggctgaggtgagaggatcgcttgagcccaggaattccagaccatcctggccaacatactgagaccttgtctctacaaaaagtaaaaataaaaaatttagccagcatggtggcccatccctgtagtcctagctacttgagaggctgagtcaggagaatcacccaagcccagaaggttgaggctatagtgagctatgactgcacagctgtattccagcctgggtgacagagcaagaccatgtctcaaagaaaaaaaaattaaaattataaaatgaaaaatatgttgctttagttttacattattttatttctaatagttgtgaccttaagatggcactaatgcggctgctttttaggaatgaagaaagtcttagaaacatttttctccatagtgattagagggcatcgtgatctatgagttcttgactggggatgctaagatgcagtcaagttgcccattaggactgactagccaccaattcacactttaaatttgtaatcatttaaaacaatcagaatttttcacagtgcctgcttttcttctttgtcttattgaaatactatttttagagatttttttgaactatagcagtttttttgttgttgttgtttctggtttttttgttttttgagatggagtcgggctttgtccccaggctggagtgcagtgacgtgatcttggctcactgcaacctgggcctcccaggtgcaagcgattctcctgcctcagcctccccaatagctgggattacaggcacgcctcaccacgtccagctgatttttgcatttttagtagagactgggtttcaccatgttggccaggatggtcttgattgcctgacctcgtgatccgcccacctcggcctcacaaagtgctgggattacaggcgccagccaccacgcctggcgaactgtaacggttttaagcaaagaaatctgtgagtaatcaaagaacattttaaataagagtagctcattattttaaagaggcagtaaaatcttgccatggcttgtttgatttgttaagtcggattttcttacagtaaagtagaacatttagaattaaaagcacagagaaagtactggaggattatcaccaatgtgataataagattctcttaaattcagtaaatacaatacaggtaactcaggctgtcatctctctatgtattctagtataattaccacatacatacacttgactgtctaaaacattttttatttctaagttatcagtcaccttataggtctcgtaataaaaacactgcggtgatggtctctacattcagctgaccttaggactcattccaaactcctcatttaaggctttatatagcttactagtggctttactttccaagaaagaccatgcaactgttcccatctccatactgatttacagcttctcctggggcagtgtcattccttttcttccatccccattattcatgtttctgtttagacccctcgctatccatgaatccttctttaatcacctaggtccacattaatctctccatacctgtattttctgtgaattactgactataccatataatttgacacaagataacttaatctcttacattgcatggtatgatactactacatttttatatcacaacatatgtagcaccagtggcagagagtattacatgagtgactaaaacatgtattgatttagagagcagtaaagtgcagcgtaaaggagtatgtgctgttttcctgtatgtaacataagactggttgaaaagaaacatctcgttcagcctttgggaagagctttcatcactacttgctccaaaattaagactttaaaaatcttcagtaaaaaaagaatgatgtctggatcataaacacagtgctatatccaaaaggtgtgataaagaattctaagaaacaaactcatggtgtgtattagctttttttttttaagttattctttttcctttgaatcactgataactgtccctaagaaataaagtacacatttaaaaaatactaaaagagctttgtggttgcagaggtgtaaacatttttatttccgtgggagtttgtaagataagatacaagcttaaactggattatatctttacacacaaatttaaaaacttttagtgatttcagattatcgcttgtattgaaatgtgttttaatttttgttttggatgatctttattggctatatttaccattaacatgttgttttgtttaatttttttcagctatttgaatgacttggacagaatagctcaaccaaattacatcccgactcaacaagatgttctcagaactagagtgaaaactacaggaattgttgaaacccattttactttcaaagatcttcattttaagtgagtagctttgaaatatatgatttctaaatttagataaaaacacattgctttagaaataaaaagtgtaataaaagtttacaacatttttacagttggaaattacagttggaaaaaaactttcttcagatgattggacaaaagaatgtttgggagaaagaagtcaaaaaaagcattcctaagaggaatgtttttatttaagaaaatctatccacacaaattccgttttgcctatagtttttacagtgattcaaacaaaatagtttttggcttttatttctaaacaaaattctgctctaatatactgtgttttcggaaagtgttgccatctatttttaggtaataagagagcaagttttactgatagcataagtgcttatttatggaaatattaagaagagcacctttaacaattttttcgtgaacagttttcttcatagggaacttaccttccctatgaaggtagtccttatgcactatttcatgataagaagtattcatttaaagtgtactgaatatccacttactgaggtcggagcagaaaagcaccgaatcgtagtctttagaaatgcaaggggtcttggagtgcatatttttccagttccctcattttaagatgaacgaggctcaggaaagtttagtaaaatatcatattcaaatttacaaaactactttcctctttttccagtaaataacattttccaaggtatgaggagaactgttggacttaaacacaacgaaatataatgttttcatttgcagagtcttgttttatctatacagccttcctggtcagttaatctgtttcccttccaggtcatctgctagtcattaccatgactttcttcttctaaaatgctccatctactgatttcattgttcactcaaacaaaattacccttaagtctgtactgttattcatcatttctgttaatgtaatagtaaaatcatgaaaaaagaaattatgtagcctatgtaaatatatatacattaataagataacatcacgggatattctactgaaacaaaacttctgtattttcatagacatctaagaccactgtagtgttacttgatgttaaaaaaatatttaaaaatacagatgttccttttttgcttcttagtattatttatttcagtacattgaagctaaataaagaggcagaagttctttttttaaaatctgctagtttcttataattcacattcatttaaaatgtcacatgtcccaagtgccagttgagtgttcagctgaaggaacaccaaacacaaagcccttgaacagctttgggaggcccgtctgaagtcaatgactaatttatatgaatataatagagtcacattattcacacagtattaaaacctatgcatgtcctataccaaatattcctggaaatgaaaataataaaaatgctagaattaaatgagttgtagacttacagggattttgttgttcttttaagtttaacagatagggatatttttgttttttttttaacccaacaaggttaagattgattttaaggaagattgccactgcagtcatgggcatcaattagatatcatctctcagctgcagagctttatagatacgttgacccaaattgagcacactccagttgtcactgcaggaaattggattagaaaaggtgtttatgatctgttttttaaggaaaattttaatatttcatgtttttctaaatttcaacttttaaatacagcgaaggattagataaatcatttgttaccagtttgtgatttttttttaagattatgtttagtggagttttttggtttctttgtagaaattcaaactttacaagaccgtgtatatatctaacttttacccaactccatccccacaataccaaacagaattttttaaaagattacaaaagcagaaagcagaatttactgttatattattctgtttgcaaaaaagtaatttatctgcatttggtttgcaaatggagtatcccatgtcgttattgaaattattttgtcttttttattttcattaaaaattgtatgattcaacataatcattctaaataaatctttactgtgaattatggattaggctttgcttcagctaactctgttgctctgaaatggtcgtgatgataaagcagaatttctaaaatcatcttggaaaaaaaggttcctaagtgagagaaaaaataattatcagttcatctcataaagaagtctcactgttagaagtagtcaacactgttaaattatatgcaacgatacttctgattgcttccataagtattttaaatttaatacatttgttactatcacttgtcactgatttacaggtggttcatgtaattgaatttacagaaaactaaagctttatttcaatttttcatggctacttctctccaaaaaacaaacattgacctgctttcttaaacaaagatataggtaataattaatttatgtggcaacattagctttgtgctttaatacatgctatggtgttgcatatgcttttttttattttcatttttttcttaaagccttcagtggacattttacgctgctgtcattatctgttactgaaatcgtttaacttcttttagtctgctcattactatttccataatattaaataaacaaactcagtactctgatttcaagtaatcagatatgtctgatctggagaatattgtcattttatcttaaaactaagaagtgattttaatgacaaggaagttcactatcagattgggacttagaattttttttttaacctagtataccttagattctgattttggttttgttcaccttgttttaaagattatgttctaaagcaaacttaaattatgttcaggtaatggcttacggtagtctccccttattcgaggggatacgttccaagaccccccatatatgcttgaaactactgatagtactgaaccctatatacaccatgtttcttcgtaggcatacatatctatgataaagtttataaattcagcacagtaagagactaacaagtaataataacatagaacaatcatagcaacgtactataaaaggtatgtgaatgtggtctcactttctcaaaatactgtaatatttttggaccttggttgaccacaggtaactgaaactgcagagagtgaaaccaggagtaagggggagctactgtatttctaaccaatattgtctgagaagaaaatgtgtggagttggagttaacaagtaaagattctagacttaggttcccctaataagtagttgggtaaacttggttaagtttcttaacaggctattacagttttgctctgtgttagaggcttaaaaataaaatgagttattgcctatgaaaaatgttgtaaaagtgagaactgtatacatagtaataagtggcagaggcaaatattaaatcgattatttggtacttaaggcagtctgactatataaaattcacttttcatcttggttaggtgcactcttaaacatttatttcaggaccatagttttcacttccagcctaggtttttcaaacttgtcatttcaacatccagcaaatactgggattcagtaaagttgactctcaacattatccttccaggaggttcatttatcatactccatttaggcttcttggttgaggttgatgtatttagttgctgtttttatttggtgacttaaagataaacacacgtttgtcaggaacctcagataaactttgtcttattttggattttgagttctgttaaattactatcattactagcatatagtttcaactttgctttttataggttacatgagcctcagatgaatgagagcagaaatgcatttagaataattctactgggaactcttgagtgtggtcatcattttgtggtttttttcgtgctcttcatgttgtaattctgtttaattttaactgctgagtaaaattcagtttcacattaaaaaatggtattaacaaattcaaaatgaggcaatagggcatcataatttaagaattcatattatccctgtgattaggcatttatggccagtgtctatgtggatcattttgctttaattaaagaatcagcaactgtgttttacttttttttgtcagatataaagcattctttctatcctaaaattatcataatatgagataaatttctatttcatttctatagtagtataaatgcgttatgcatttgggaatgcaacatccagtttatgagtttgatatccatatatggttagctagctttgtaccagttagttttggtgacagtggtattagatgctagtctaaggcataaatcatcacttctcagcatgtccaacatctccttccaccccacccttcagaatccctaagaaaactcaaattcatttcctatgtgatgttggtttaaactcttatctttttatatgaaggagaaaataccatatttttgctctttttaaatagaagttcagaacttaacagtatataaaataatgaagatacttctaatataagtgtagagcaatgaataatgcttgtacatttttagctaccattatatggaaaatgaaagcagtgataaaaattagtgtttcttctagttatcttcatctagctctctctgaattccaacaaacttaagcagtttgatcatttgtaatatcagttctctgtcattgttgcttctggattaattgacttggggattaattgatcctcaaaaggatggtcccccaagctagtaacatctgactcctaacattctgaatcacatcaaagtttgagaaccactagcttagactctgagttctttgtttatgaccatgaccattctccacctgtcatcacatgtcctccttccctgtgcgtctggttccatttggcttaatagttcattcctcagtttatctcttccactctcattttactataagcagcaagcaggaaactgcagccttctacactttgcttgcagttttcctcagctaaatatccaagttcattgcttagaagttgcaccttccacccagcgctggaacacacagttcagccagctgtttgccactttataacaaggactgtcttctctgtagtgtataataacatgttttcatttccttctgagacctcattaaaagctcctttaacgtttgtatatctacaacattctgtccacaatgatacatgtattctctaagacaacagaaggttctttccagctttatttccatctcagctcttagcagaattgtctttaatctccctatttctaccagcaatctcttcaagatagtgtagttttattttctgtcaaatgcttaaatattcttctacctcctacatattacccaattccaaagtcacttccatgtttttaggtatttgttagagtagcacctcattctctgcactaaagttgtatcatcagtattcaccagaaaagcagatccagtaggttatgtttatttcaaggaattggtttatgggattatgaaggctaacaagtccgaagtttgtagggtaggctggcaagcttggacatgaattgtcataacattgtggaggaagaattacattttcttctgggaaacctcagtttttgccagttttagcctgtagagtgattgagggctgttgtattattaaggatagtctccattacttaaagttaactgattacagatgttaatcatatctataaaatacagcaacatctaaataagtgtttcattaaataacacctagataaatgtatgatggcatagccaagttaacacacaaaactataccatcacagagaggaaatgtgggctagggtcatttgggttgttattgacatctgttattggatggacagaggatgtgtgacatctaatcagagaagttatctgagatatgctatcttttcagtaaagttattttcaaattgtgttcctgggcattttagcaaatggtaacccaatttatatcattttaatttactgtcatttattttgttcttgtttgatcgttattaccagctatgttttttacatcttaactctgtgatttagtttgtggtagaaacattttgttatatagcttacctgaatttaatgaacaatggtaccagctaagccaaaagaatgaagaagcccacttaagtgatcataaaagtaacaatactagttgatgtactcaaatttggtttataggccagtactgctctgtagggaaaattctttttgcctgggaattaaatagggactattttaattagtgcaccatctagataaatggagcctttaaaaatgtaccagttcgcatagtgttttcattatataagtggttatttctaggttgcataatgtagtctatgcaaattttaacttttgcttaactttataaagtcttataagagaaaaggaatagactattgtctttatattgtttgattttgctactactttgttcactaacctatagtggttcactcttgtataaaaattgaatttttttcattctaaattttaaggccattcagtaggatccctcatttatttcatatttcagttctctcattttgtaatgtatcatgattttactttttatgcaaacctaccctatctgaatttcatttgcttgccctacattttcttacctgaaatggtttcttctttacatcaaagccttgcttattatttctgagttaaaacgacatgttttagtaggaggaggggtctctgttctctgccttcaatgttccgtgactgtggcaaatggaatatttactctttgatctctgcattccccagttgcttcatgtgacttctcagtgtttacacatagtgcagtccattcatttgtatttgctttaatgttctaagtgttctcatgtgtgttaatgtctcgtttttttgaggttatttttgtttttgcttttttttttttttttagagataccctcccttcaatcaaaaattttaaaaactagcaggtttttttccccttttgagaagtccagtttgtgacatttttttctcccataaagtccttctctccttccttttcatcagacatttccacaactattcagagctttttttgttagcattaaagaacttctcagagctttttgaacatttaatgtgatgttaactcatttctcctcttaacagaatgtttgatgtgggaggtcagagatctgagcggaagaagtggattcattgcttcgaaggagtgacggcgatcatcttctgtgtagcactgagtgactacgacctggttctagctgaagatgaagaaatggcaagtagaactactttaagagttgagcttgaaacatgaagagctgaaggtgttgccaagaatttctttctaatgtctataacaatttgaaagtacagggtctttcctctaacttttctatttgataaaagagagatatactagagaagcacaggtggatcttgaggaaaaggaaaacatggagagtcaatctcacctcaagcctgtaagcttaactatgcatttctgtatctaatatcaacatagcacatggaaatatagttacatagtagtccaagattcccttttcttaatttgttacttctgttagtttagtaaatctttttttttttttttttgagacggagtctcgccctgttgccagactggagtgcagtggcaccatctctgctcactgcaacctccacctcccaggttcaagccagttctcctgcctcagcctcccaagtagctgggattacaggcacgtgccaccacacccagctgatttttgtatttttagtagaaatggggtttcaccatgttggccaggttggtcagaaactcctgacctcagatgagccacccatctcggcctcccaaagtgctgggattacaggcctgagccaccgcacccagccggtaaatctttaatatatgttatgctttgttgctgccctgtaattttcagataggtttcagtgtaccattaatatgggggaaatgtttttaaatagaaatgtaaaactttgtcattttaagttaactttattacaaagtgggggaaaaagtagaaatgtcggttttgttcagttgacccttgaacaacgggtttaagctgcatgggtccacatatatgaaaatttttttcaaccaagcacattcatgggatgcaaaacctgagtatacagaaagccactttttcctatgtgtgggttccacagaactgcctgctggacttgagtgtatgcacattttggtacccttggaggtctttgtactaatccccctgagtataccgagagacgattgtatttttaaaatcaagtatatgaaattatagtgtagtaggtgcagtgcaacaccacatgttcatttctttcatttcagcactataaaatgtatcagtgccctctttgatgagcacagatcctggaaggtcaagaaacaggaattggaagtgtccttccagtatttatatttattataatatttagagtattgggctaattgggtcttagcttgttcaatttaagttattaatctttaaaaacctctatttatcttctaatggaaatttagatgaaatgaactctatgacaatgtcatttcttttcacatgttcacacttcacatccctagattataatgtcctgtagcaggatattccctggcacagagcatgacatatagtgggcacttggcaagtaaaagttgaatgcaaaaagtggtgaaagatgattagacacttctcttacctaaagtgaaagtgtgttctgaaatggcagaaatgtatttttgtgatacgtatttttcaatcactaaactctgttttattacaacaccttttattttttaaaatagtcctcaaaaatccttgctgttagtgacgattggttttatttttttctattacagaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggtattttccttttctgggaataacttgtcaagttacatatttctaagtgaaacttcccctaaggcaagaattcagttgttaatttaaatctcttggcttagtgattcttagacctttaaggggtattatttatcaaactgcagttgagcataaaaatttccttaagatgtagatgaaattactgaaaataatgtattcattttatggaaaagcagttagataatttttagtgatgactccaagttaaaatactattttttaaatccagttaacagatttcatatcaggtactgtgtgatgtacaataaataagacatgtctctgcccaccatctaatctgaaagacagacatacttaaacaacaggcaatagcagtgcaacctactgctaaaataaggaacatgaacattatagtaaggggaaatgaagacaggatcattgaggcagctaactcttccagaagggcagggaaggtttcacaagaagccaaaactttggtaatgagactgttaatagtgctttaattttactatgatggaaaattccctggagtgaggaaagtagacctgaagtacagtcctgacttttccataattagctctttgatcttgaacaaggcagttagttcacctaggtctcagtattccatctgtgaagtcaggagttgggctaaaacattagttttagtttaatttagttccttggagcacctcctgggttgctgttgaaggcggaaatgggagagggaacagagctaattactgccccctgcacccaccaccttataactttttcattaaagcagagtaactcagctttcatctggtttatgtattgagtaaagttttactttagtgaagagcattcagtatgccttaaaaaaacagggagtttgattaccactggtttatgtaatctccaaatctagatagtttgaagagtttagttatttaccctcaccccactcttcctgtttttttttttaaaagtctcaagaatttgtttttttataaacagaattttcctcagtcttgtgttgagtaaattgtacgatgagtattcactgccattttacaggaaatgttaagacaaccctgtgatgtcagtgctcaggtatccctacccatacaaatgagaataccggggcttcctgaagccagagtccagttccagacccaagtccattgtcctcctgctcctagaccatgaacgactaggctacatttaattaaacattcagtggaaccaaaaggggagggttctttggtaaatataatcatgttacttatagctctttttgtgtacggtgaaattacacttcagttcaaactaatttcacacatttacttactttaaaactttgctttctttttgaaagtcaaagtcctaaatcactgtattcagcaacatttttttgtgcttattagaaataagctacccagagtcaagatggcttaatttttcccttatttgaatatatttttcagtttatttttatcatattctatgatgtagccattttgtactaattcatagtaccagattccccaagtgaatccataaatattgtatacctacggggattttagagcaactaagaatatacttgttagctctttccttgccaagtagacagtgtgtttaggaatttttgcttgtgttttgcttaagttaataagaatacctgacttcagaatctttgcacaaaaagaatattacataattctttcacatccccagagttaagattattgtttaagatctccatggcatgcccaaagtattgattcagttgcttcttgcttcagccgcaactctcaatttcctgtggctgtggaagaaccctgtgtagcccctaaacaactcacttgatttatctcctgtctgtctgctcctgtgttacccttctcctcctcttctttttcctgtatgttgccacttcaccagtttcatctgcagtcacgtcatcttagctctcttatcctttcatagtcgtatctattctcaataggttaaattttgtggtcagccctaatttctctctggagccttagatttacattagcaactgcttgaacatacatgttttgttgttgtttggttggttgggttggtcggttggttggttggttagcacctgaagctcaaacagaactctttttcttgtttacactcagatctcttctctttcccttttgattgtgtcatcagcctcccagttcttcatttttgaacctggttatcacctatacttacctttgttcaggacaattctatcacacattaaaaaacaatctatcatatttgctctcctgtccctgctttgccatttgtttcttaagacttaaaatcagaatgaagaatgttcattcatatgtgttgtagcttttagggtaatctagctagctgcctaggatatatagagcaaattgagctaggcactcaatgtaagctgtttggctgaagcatagtttaatttagcagttgcattagcttctgtgggccaacaagatgctgttgattgctttaaaattttggagaacgaaacttatgatttaataaaatttgatttttaaaagtatgtgatttctagtgatataaaagagttaaaatgtaaacttaaagacgatagctttagtacctttttatccctaataaaaatctcataatctatgctgtcatagcacattacacaacattcctatgggcatttgtcacattgtattacactggattctataagatataaaaggagtatgaggcttgtggggtatgatatttactcttgaagagttcacattctagtttaggagattcagcactgaaaaagaatttaagactctataaagcaatataacaaaaactgaaatagttatttctaggaggaggaaaaagtttttaagtgatagagaacccagctagatttgattaattaggaaaagttagatggagtgccaattttgagcaaatgtgaaggcaggcagagatctcagccggtgaagtagaatgaagaggaagtactacagtaccacaggtggcagtttgcatgttaggtcctcacgacatggacctggggtgagcgccagtgtggaggagaggatctcagaatgatggcactgcagagcaggctgggtagtagaggaccttgaaagtctggcagataattttggattattactacaaaagaggggtttaaacagtttttttccaaatgaaatttgaatgtttttcagtttttttattgaagcattacatagagcattacattatatacattaatgtatattataatattatgtacatacatacatacgtacacacacaccctcagcataagtgcgtgtttaaaggttaatgtaccagtatccaccactcaggtcaagaaaccaaacagcttcaggaccccagaaagccccatcatgcttcctctcagtcttaaccaatcaaaccctccccacaacacacacataacacaatcacaacccatacacatagtaatcactgattactcactgataatcactgaagaccttaataaaagaaagaacacaaaggaaatatacacccacttcacatgttccacagacactattggtgaggtttttgtcctcaccagttcatttttcaaacattgttggatcatacagtatgcgatctttttgcatctagcttcttttgctcaacagtacacttaggagattaattcatgttactgagtactttcattctcacttcttctgtgtcttcagtgatacacagttctgtcaagtgtatatctagaaactgaattgcggggtcagagtgtgtgtgtgattatctttagatattgccaaacaatttctggagtgtttgtactcagaggaagtcttttatagtcaataacctgaaagctggagtgtgtcattcactttttttgtaacctcatactcctaaacatcattgtagaccttggtacaatttttgaataaagaaaaatgagtgaagaatgcaaattaatgtatatatagaaaagggaggaaaaaatactgatcagcattcagccaacattttttgatccaccattgggccagaactgaaatagcatgccgtcgtcaagcatctgagctggggtgtagaggacagaggataagaggataaaagatctggcatttgaggattgaggcaggaacaaagatcatgatgaacacggaatgccatgtaaaggaaattttttgtttaagggataacttagtcattaaaggtaattaacatggagtgtttttcatttagaagaaatagtgtctcccattctagaagggaaagcacagttaaggagtccatgaatgaaactgtatgaaactgacttcagtttcatatgtatgaaactgaattcagtattttaagcagttattttaactttttgcatttatgtttctttcctttttccatctcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgtacaaacattgcacagactattttaataacatgatttgttctttaaattttatgtgttttattgaaatgttcttaagatgaatacacctgcctttggatcaactatttaaacattgtatgcattttgatttttcctactttaagaaaataaaataatttaattttacattagattccacgttagatttggtttgaaaaactaaaatttcagatttctgaggatatactgtcttagacttattgtacacacttagtttttattcacttgttttcactctgaattttaatatttggctgatatgaatgcattgcctcaaaggtgatgtcatcttaatttttattcactttaaataactacatttttgtttataactaagtttggagggatcctaagagcatttttgtgggtaaaaaaaaaacctgtggacataatgaattttgagacattgattggtgaggcttttatttcccttgaggagtctcttgtacctagcatacatgatagctccttgttgggaagataacaagaaggatctttgaatactctattgctgatataatgcaagatttaaatttatacatataactaatttcaaatgtaattatcacactatgttaaaattacttttttcccttagataattcaaatttctccacttgcttgagattatatcatttctttttcaattatactattatttctgagaatgaaatggacgattacacttagaaaatgagtaatagtgtttaataagtcagtgattatatgtgtgctcaaataagtgttatgtatcagctagatactgagctttgatagaataattttcttttgattattcatgatgtgtcatctctgaccttgtttcagcaaagtaaacagcactccccaccccaccctcctttttttactcatcttggaaaaggttagtctttcagtacacgttgctggtaagtagtttccaagttacgtgttgtcactgggttgaagtatatttgtgtgtgtgtgtgtgtgtgtgtgtgtgtgtgtaaccataaactatattcatatctgtttcatttggaggattttcttctttgtaatgtaaagaaattcaaagttatcaaagttccttaaatgtgttagtttagattctttatgtgcctttcatgaaagatatgttttcattaattttactggtggacctgtaatatccacattgtgaagctgtgtatgaaattcaactataatatgaataaatttgaatcatgagaattatgggttaaaaagccacaaagaagcacatattggtgaccatcattaatgaaatcctgaactttattctgtgtaattgtgttaataaatcctaataaatttaaatttttaaaattttacaaac

SEQ ID NO: 37275 - DNA, 29683 bp, Homo sapiens
acaggtgacgctcctcccgcctgcctagcagagctccaggcgcacatccgcagtcagccacctcgcgcgcgcctccaggagcaaggatggagaggctggtgagcggggccggggcttgggaaggagggcgcagggcaggcgatgttgagccggtggccctggggcgggcggcgagtggaaggcgcggagcttcggctcttgccacaatctggtccggggactagatcagcggtgttgatggcagcgcttttctctaagcgctttctcttgctgagaaacggattttgccttccaaagggtggtttacaggcagctgctggcgtccagattctccattccaattgcctgaaaaaaagatgcaccaggccggggctccgggggctcttgatccgcgctgacgaagctggcgcatcctccgggcaggctcggctcggctcactggctccagctcccaaaactggggaggcacagcctattttaaactgcccccaaaagggaaagagaaatgctgtattggttccatattggcaccaaaagctgcggcggagatacagatttccaggctcgctttctccgggagagctcctgcgtctcctctttgttatgcagcccctttctccctcctagcccttgcctgggggaagccatgaaggatcagttaaagctgaagctacacttgagagagctgaaatgctctgtgatcataatgctttgaagggttaaccccgggtatctagagaaacagacattttgtttattcggaaccagcttacaagacaaaaaacggagaaggttttcatatatcccattggtatatgaaatccaaatacaatggtattggtataagaatccaaatacagtgaatgcctcaagataattttttcatgtatggtttgttggcaagaccacatagccaatgatttcactgtctttcttaacaaaggagaatggtggtctgtgagctacggtctactgcaagctagatgctgttaatcttctttgtaactatccttctaaaaatgaattattacctcgttttacacataaacaggcggaaaggctgatatttccaagtccttgtgactacatgtggggtaatgtggatttggacatagaaacttgctgaggaagaggcatgaataggggcaatatagctaccaggtgggcagctgtctggtaagacccaggtttttgtgaaccctggactgcatggcaagggttataagtgggcttctttgttttcaggactgtagttccccctatatgatttgatcgattaatttttttagctacctaacacgtattggcatttactataacctaggctctatactaagtgctttaattgcctaattctcataataactatgtgagataagagcaacatttatttagtgcttatttctactggcagtattctaggagctttatatactacttcatttagtctttttaaccattagattggtactattacttttccggagtctcagagaggtaaaatgatttcttttgctcacaaatctagtatttgttttagccccggtcacctccctgtaaacatataaatactgttgttttcagattggtcgtattttcagttattctgcacagactcgaggaaaaaaaaaacctgtaaaataaaaatacgtatctatttaagagtaaggctttccttctgatttcctttgcctcaatcactgtgttttgtttcttaacattgctggctcccagtccacaatatatggtttggtatgtatctgctttctctcttgtcctaaaacacagattttctctatgagagcttgtccattctgcattcttcatcatggcctctggtagagcctggatttccacgtcagagaagcctaatggtttaaaaaatatcacatagaattggaatgccagtatctgtctccacaattgccttagctgaaaataaaacaaaatgtgttgggtgggcactggcaatggagcctgaggaaatatttggcctgattttttctgactttcctagataattagataggatggaacagtctcagtaatactgagaaaattatcgagttatatattttttttcacttcaaaaccaaagcctttgtgagtataatacccagcagtggatgggcagggtgagcagatctttgtaggctgtatgtattcaggcagctgaaccatcttgggtttctcaaagagcagtgactatgttattagtcttagacctatgaagacaggaagagaagtcacaaggaagggatagcatgcttatggtatgcttgggtatcgaataataaaatatatctgcaaagaataatttgtcctaatggcaccttcagatgatataatcttgaattctctgtagccttagagatgtaaggaaaaagcaacttacatcacaaagatcagtattactgtgtactatgatgccactgcatggggtccaggatgagagtctaagtgattggttctctctagctgaagacaagaagacactcaggtatgtggcagcacttgggataggccacagggcggcgagacatcattccttccaggacatctatcctgaaagatccatcaggaatactgtgatggagatagtgatggagactccttgtctctggcagttagagtgaatgctgaagaagagcccttttccagcaggccagtctctaacatgatcttgggtcttcacccagaccatgacagctctggtgctcaacacacacaaccacctccagggtacaagttggccccaagagagctgagacaatattggctctaatttttatcatctcattgatctcaaaccacagactctgaccaggacaattgggggccctctccttacagctacactcctaggaaagaccaccatcaatgattaccaggtaattttctacccctacctatgaagggacttggttagtaacttctcttgctagaggaaaaatgaagcttattatataagattaatgtttgtgaaacacctgttatttggaattggtttggtacttcctcttgaaatttccctcattaagtttaggtcgtggctgtttcataaggaaagaaaagggcatgtattgactggaattaaaattaacaaatccattgagtaggaggatattaaaattgagtggctcccattggacaggaaaaggaagagaaatccttgtggcaggtaaaggaggagagatttagatccttgagaactccattcccgacccgctgctcctgagcccacaggaagaaggccatcacaagacaataaaaatcccagagaaattgaaaggcaaacagaaagacccagcttggagtgataaggaaaatgaattccagcagggaagtcattgtatctaaaaggaatggcaaaaatagggcttagttaaggcaaacaccgagaatgaggggatgggattcccacaggtagaacaccaccctttagcaatgatcctgaccctaaagcaaggtcatttaagtgattatgggccaatattctagaaataagcttcaaattatagtagcaacagatggggctaaacaggagccgataagaacatacaaacaacttcagaaagggatgcccgtgatgggttcattaaggaaaaagtggtcaggacatcccgctaaagcaacaggattcagtggatattgaggttcttggggggcaatgagacaggcaccaagagaccactactttatggaagactatgatcatactgctaaataccataaaagaatagacagagccaaataagagactgtttctaatgaaacaagcagacaatgtcccaacctcaggaatttaactcagtctgaaaaagaagagtagtttcaaaactgtcaagcctgctttagtgctataatttttttcactgacaagagagaatgaaagactgatagctgggggagtggcggggggtgaggggtgttgacaggtagtaagcatgctggaaacagtgtctcaaggtgtggggtatatggtgggtatatttgggaagtagtcattttctctcaaactggaaagcagatgggtgtgttcagacaagatctggaagctgtggcatggcagacaaagggagatgggacccctttggcactggaggaagaggcttgaatcttcttggagcactaaaagttccaaaagacctaagcagaaaatgcttccgaagaggaggatctgtatggcaagatgactgtaatcaggctcataaaagtaagaccttacataaatacaagtgagggggaagacatttcatgtaggaggaatggctcaagcaaaaataccaaggcgggaaattgcgtggtgcgtttagaagtagaaaaggctagctggcagggaggggatacataggaaggcaatggaaatgaatttgcaagaatgaaaacaggctaagaactttgaacaattttctctagatagttaggggctatagaagaagatggcatcttgtacaaagaggaatttaaggaaaattaatctgtcaatagtgtgtaaatacataagctggatagtaaacttaactaagttagggactatatctgccttatgcaccattgtctccaaagtacctaccatagtgcctggcatgaagtcagactcaatagagatgattaataatagaataaatgaaagaagtatagttgtcccttgggacccatgggggctttgttccaagaccctcacagataccagttggtggatggtgcaagtcccttatatgaaatgctgtaatatttgcatataacctatgcatatcctcccatatatataaactcatctcttgattatttataattttaatacaatataaattctatataaatagttcttatgctgtattatttaggcaataatgacaaaaatctgtgtttgttcagtgcagatgcttttttaaaaaatatattttccatctgtggttatctgaatccacggatacagaaccaacagatacggtggaccaactatacgggcaaaagttcagttccaatagaagacaagactactgcacaaaacacctagtgttatgagctgagactagggtggtaaagaacagacacttcacatgggtaccaaggaacagacacttcacatgcgagaatctaatgtgtaaagtgactaattccatatctaggtaggggaaaaatgattcatcctggatgacttgagtgcctgggagataaaagtacaaaaaagtagctgttttgggtaaaatgacgattaatttgatgttattcataaatttaattattcagcattccttcatgttttttttattcaactgacagcatcttaggcagaaggaaagataaaagaactaatgtaggaaatagcttggtaatttcaagtcattgaaagaatggtgaagtggagcttggtgttcaaggtggaaagcacagtgacatgagattggatagcatgtttgtaggtgctgagctgcaggtagtgacagatggggtcatgctttattactagcagagcttctagacaatgactcaatggctttcagagattccttggctctgtggaaaccggtttaaatgctttttaaaaacagcttcaaaattgaatttaacattgttgcagggcaatgaagcagggattgctgtgtgaatagcagtttggtaattcctcacaacgatttggtcataggcaataacaatgtacttttgtgacgatgtgtcaaaatttttaaaccaacaaaactttatacataggggaggcaagatagtgtggtaattatggttatgagctctgaaaccagactgcctgggcttaaatcccttctctgtcacttcacagctgtgtgaccttgggcaatttacttaacttctctgtgcctcatattctttattttgaaaatgatgataataatagtgcttcctatatagattatatgaaatattggatgaaatgctttatctcaagtgctaagaacagtgcctagtacataataaatgttaaataaatgttagcattagtggtttagtaaccttatgcaaaatataagttggagtattattttaatgtatcatctggtgtgattttttattccagtactttatttttgtcctctggtctttcaaatcagacaattaagcttccattgccttagagaaggaatactaagcagaaaataaattttagtttcaaaagccaaaattttgcaataccaagagccttggcattccagtttcaaaagactaaatgctaaaagaccaaggatataatgttcatgctagaaagggttgattggatgaatgcagagtgatggaggaactagcttttctggctcagggagataaatattttgtaggctgggagagcaaaatgggactgattgatgtctatgctcagataccagtttgcatccccaaaataaggccctgtgtccaggccccagacatgggaagttcaggagagtagaaaatagaacctgcaagtagttgttgagatccaagaaaaaaataatacctgtgtctcacagtcccctaaagggactgtaggaagcagcatgcttgtccatcatggcaagtgaacagtaaaacagagatggattgatacacaggaatttaggcagaaagccttgtagaattttctttcatccagcacaaggggaacccagggacagcctggaagaacatgagcaagcaccagttcatcttgtgagcaataattgcacaaactaatgacagtgatgacttgaggggaacacagccattttagccaatgctagcataatagatggttgtaatcaatgattagcagtcctgtctcatagctgggcattttgtgaacccccaggaatgcagacgcaatgctagagattgggacaattatggggtattgtggtggtgagagaccgaattgacagagattatgcaacattgactggaagtaaattcttatctccagttggaatagtaacatgaaataaaaataaagttcagttaaaaacagataaaagttacattttttaatcatctctattatgaaaaatagaaatatagaaaaaataaaggaaaaagttacatttctttcctttgccccttagtatgaacatacatacagaccaaatgaatggatccatggcactattgcagagaaaagttcaactgcctctaccctgacttaccattttatagaaggatgatgcccagaataacattatcttaaatactcccaagatttataagaaggccgaggatttctgcccagacacatgaaaataaggcagcgaaggaaaaaattaaagccagtactgctttttaaaacatgcggtttatatgtaagacttgcagaattaaaatcaacctcaacaaaattcaaggcagtcaaataatgttcttgaaaagtggttaccctctgagttacatttttaacattaacagacatggattttttgggaagtggatgctgtataacatttgtattctcagcattttctgtatttatttaagccagtttgttttccccagtgatcctatgtctttgagacctcgctcttgacaatggtggcttcaggagcaaggccccaaattgccaggcattgctattgtgttgaagccacgctgctgcttttccctcctcatatcctgagcatgctttattatttcttccatttataacctctagttctgctcccacaaaaccaaaattctctggggggtaaaaacttagctacaacattccctgaaatagcgattagattgaagcttccttggatttgtccaaatccaaacccccatttctgtactttgctttctgtcttcaggtgatcaggatgcccttctctcatctgtctacctacagcctggtttgggtcatggcagcagtggtgctgtgcacagcacaaggtaaagaaactcaattcccctgcttggagcccagcaaacacaatttctggggtgaagacatttagccagtattgtttgtgctgtgctggttccatttgtctgcatgaattatttaagcatgtaatctgcctggaggagtggacgtggttcttttctgctttccacacttttgttttcgatgtagaagcacactttgatatttagaagccgtttccatagtagatgaaccagacttatgaaaaaatcctctattttaaaatgtcatttttcacttactgaattgaattacaaataatgatttcctctgtttttaaatatatgggaatgcttgaattcaatctttttggaaagtaatctggcagtaagccttaaaattggatgtgttacctttttacagaaaaatgtagaaaacaacgaaatgtagaagttatataggctcatattatctattgtataacaaatttggttgtgccatctacttatctaccgaagttcctagctcttcctcctcagttccttgggaggccacactcactttaccactggccttttcatcacttgcagtgtgatgttgctcagcatcagcctccacagatgtgggtgatgctggtgaagatcagataggcttcatgcccatctccaactctggtccacaacattcatcacaggacttatcaactgaccagaggaatctaagtgagattccatagaggtagcaaagaattgtaaatttcccctaaatgatttcttccatagtcaaaaagaaaaaaaaaactcatctaagagttgaactctagttttgagttccctttcactctgccttctaaaagcagtaatttcttcaaatctctggtctgcaaaatctcaacaaactttcaagaagtctcaatcctagcaacagatagtttcccagaacttttcacatcttccaagagtatacatcatttagttttgaatcatgcaatactcaggggttccagcctgtatttgttatacccatctttcattccctgatattgtgggggagttgcttgtttactcagccttctttttttttctacttatacttgtcaacattttatccagattatcagtctttaaaaacaagtctggatgcttgtgatcaagtttacattttgtgtaccattttattagtgtctttatctttattaattcactgcgatatttgaaagggagggtaggaggtttggaagtaagtgtattcatttttaagtatctcttcttttctattaaatgttgctagaattaaatgtttctctgagaactgtccttccttccttccttccttccttccttccttcctttcttctttctttctttctttctttctttccttctttctttctttctttctttctttctttctttctttctttctttctttctttctttctttctttctttctttctttctttctttctttcttctctctctttctatgaaatttcactctgtcacccaggctggagtgcagtggcacagtctcagctcactgcaacctctgcctctcgggttcaagcaattctcctgcctcagcctcctgagtagctgggattacaggtgcccaccaccacgcctggctaatttttgtatttttagtagaaacagggtttcactttgttggccaggttggtctcaaactcctgacctcaagtcatccactcgcctcggcctcccaaagtgctgggattacaggcgtgagccactgcaccaggcatgtcttacccatgtctatagatttttaacatattatgttctcattgtcattcagttataataatttatgattttttctatgctttctggtgtacctaagacttaaaagaagtatgtaaatttctaattttattgtattatgaacggtgttcaaggccatacgtagggtagcaacttttttgtagcctattttgagttcaatttggaggaaggttttatgtgtgttttgaaaagattatacatcctttctttgagtaaagtgtgtgtgtctgtgtgtgtgtgcgtcttatgatatctttattcatttagtatgagttattgggtttgtaaagtttattatttctctttcattgtattgactttctcaaaagtttggctatttgttattatgttgagattttccatcaaataatctatcatagtatgagttgctaatattggagaagggaagaaatttatatttatacacacacagagagagagatctacatacatataaagtatatagtgtatataatataaacatataaaacattgataatattaaatacctaaagtatatatataaatatatattgtttttcaaattttcttttctttgtgacatggacttaccttgtcacccaggctggagtacagtgctgcaatcattgctcactgcatccttgaactcctggccttaagcaatcttcctgtcctatgctcctgagtagccaggactacaagtacatgacgctacggctggctaatttttacatttcttgtagagataagggtctcatctcttgcccacgctgatcttgaactcctggcctcaagtgagtcttctactttgacttgccaaagcaccaggattacaggcatcagccactgtacctggtagtttttcaaatttcctatttaactttttttcctttaacaattgtttaaatatattaaattgaaggttctcggtatgattgtgaatttaaattttttctttgtaattctattagttttgctttatatatttcggagttatgttgttaggtgcataaaggtttatgattactataatagatctgattttagattgttccttttatcattttgaaaaatactttttcccttcttacagtggttttgtcttccattcttttttttctctccttttagaagtcttactgaactgattttggaacatttaagtctacttattgaatttttccttaatcccttccatatcattatctctttgtgctacattctagaataatttcatggcctgttcttactttttactaatttactcttcagtagcatctattttgctaagtcagcctatctgttgcaattttatattcctcattttctatatctctaatttctactattcataatgcttttattatgcttttattacacttatatcatcacatgtattcatgtcaaagtatttattgtcttatgatatctttattcattttgtatgagttattgggtttgtaaagtttattatttctctttcattgtattggctttctcaaaagtttggctatttgtttttatgttgagattttccatcaaataatgtatgatggtatgagttgctaatattgaggaagggaagaaattaccaccatagcatttagtgaaagcagagggtgtgtaaattattatttgtgtgccaaagcttcaagatcctccagaacattgtcccataaatctctttacctatgttcctatatacactcttgcttcctggaggcagacacctctgttccacctgcttcctttgtagattgtgtatgtgtgtgtgtttgtgtggaatgcatagggctgctccatcttctttacttacagtggtcactctgcctgttatcctttggccttttcctgctctttgcttctacttctccaagcatggacaagattggtgaagctgctatcctacctggcagtttacatcttcaatctcattgtacctacttcgcagcttacacagatcattcacaatttcttgtaactgagagttgctctcttgtttttctactctgctactattctttaaagattgaacaaacatatttgaacctatatatttctctggcatcacgtaggaatgtaaataaatgttttcttttttgcattttctctttcttttctatatttgacattgaatatacattttatttataatcaggaaaaagtgtatgtgtgttacaatctttaaatataaatgttcttttatgattccatagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatggtgagaatctctgagaatcattgtctgtgtctggaaatactatttgcaagaatgtttggaatatagccgtagtgcccagtttttcaggattttaaccacagaaagggtcatgagaagatagcctttcttgtctactatagctgtgtttatgattatttggagagttcatggggctacactgagttctttggctggagctatcttttctctgagggatcctgctgtcaacaggagaaatttgaggacaatggtgagggcaacaagttctccataagcagtgatatgattcagacctggctttgccactagcaatcatgcgaccctagaagggtcctatccactctccactggagtttcattgtctggacaataagtgtgaaatagatcatttctagggtcacttacaacttcaactttttggatctaaggacagagccagattggactagccttgagccagttatgattgtccttctcattttgcttggggagatagctctttcaggattgataagggcacatagagcagagccttttcatacctgaaatgatgccaactaaagatataactgggcaagagcattcttttaaaatccaagaggcttagtttgatgaaattcttcttaactgacacacagctgagatgaaaggttacgaagtgagaataagagattactttggagcatggcacacacggcagtagttttagggagtagaggacaaacttatggttattaggaatattaaggtgagagtttactcatgccaataatattgcccacagggaagaaaaggcttagtagatgagaatgcaagggagataggacaatgccaaaagaaatttcttttacttattttgcctataatgagtcctctctgtagaatcttatgttgtttctttcttgatttccacttctttcattctctctttttctgtttctcctccctgtctccttccttcctttcctccctctctgccttcctttcttctttccttcctcctaatttttctttttttcttgtgtcatatttttctcatttctgttcctttttattctcttcctcttttcctcacctttctttctcttagtctccttccttcactcatagacttttgtatttttttttcctgaaaagcagatgtctctgagctttaaagctagtaattctgttctcttccacactgaccttttccatccacaccttataactttcatgtaagccattctttgatacatcataggacctcaacactcagtctggcccatcaaccatattcatgttttttcatttctatttcccttcttccagcgctcacagacattagtaatcttagccagagccacagttccatagccctacttccccaacccagtgtcttctacctgcctcttgaacctataagcacagcccaggctttcagttagcactgccatttaattatcttgtgggctccaaagccaaccacagaaagacaagtttacatctgcttagaaaagaaaaattctatattccaacaaaaatgaactcactagtcaggggattttcaaaagggtacaggctacagctggcctgaaaataattttctcatgagctagttagtttttcttaacttaatcaggtgatttccagtgctcttccaacagtcatttcttaatttttatggttattagctacgaattccaaattttggttttgtgtagctcttccaaaaagggattttccagctctcctccatgcgtctaattcactggtccagctccaagaagaaaatggctatctctaagcagtagcctttctatgggctctctgttccaaaactgccctagtgcctctgataggtacaggacacatgtatggcagtgctggttggtggttattgtcaagccatttaagaggaatacccagaagaaggcagagatgctgcattgcccctggaagagaacagaataattaggactgtttgggagagaaaagtatcatctgacttctcaatactctatgtccatctgacaaattctgctacagacaaattacagaaagggtctttctcatcacaggtttgtactaggccagtctccatcctgcagatcagaaaattagacacaagaggaactggaaagtccccagtttgggtaggatatgccatgctatctttctagcctccattatctttctataagcatatttccttcatctctctgaggagactgcaggactcagaccaggtgcttaactgataacagatcatatttattttttgtcccagtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggtaagagaaagtgagcaaggtggctgtggttgtgtctgtgtgcatggacctggaaggcagtgaatgtcctgcagaggttttcagcctcttagcataatctatttggagaaagaatggggcaaataaggaaaaaacaaaacaaaacaaaaaaattgaagaaacaaataaagcaagttttactttcataaatgtggttcattgcccacacaccaaatgctgttgctgagatccattcatttatttatttcttccactctactaacatgtaattaggtctgttctgggccagactttgagttgaacatgaaaagtgcagcaatgagcaagactcagtctctaagcttctagtctactagggaatagagataaatggatgggcaattgtaaaactgtgcattacattctccagtgagaaagctatgatgcaccatgggaggattggaggttgggaaggaggggctcaatctgggggagatttggaaggtttcctggaagaagtgacatctgtgatgaaatcactgtataatctacactgtgagaaagggacctatctgaagtgctttcgtcacccattttaaagcaaactgcctcctatccaagtccctttttgctttcttgtgtttttgtctaaactactgtctctgggcctcatagatacaagaggtgagaatgacagaggagagaataaagggagcagagattataaagacaagaagttttagcaataatagccacgtcttttctctgtgtagttttgaagcactgactcttgatgaagcagtcagtaataagcctcctaaaaagtattactcctcttttttggagaaattatgagcaataaactggaaaagctttctacacccacctctttactgcagtggcctttggagtccctgaaaacccagactaatcagaaattggatatttaggtaaatttggtcaaaaagacttgcagtgttggatttggatatttgtgaagagatcttcagattcagccatggcaaagggtatatttcctggaaaaacaagaacctaaaaaagaatgtcttttttttttccaagaatgccagatttgacttatatcacttacagtgtttatataccacttgtataatgtttgtttattctgtgaacatttaccaaaaaacttccatgctcaaagcattatgtcaagcactggacctatagaaatcaaacaaatccctgtctgaggtctgaggtgttcagttaaataatgatgtgacgaatcccattatggaggtatggagaagatgctagagactcccaaatcaaggagttcctcatttgcctttgcattgcaacatgacactgaggaactgatatttaggctgagttgcattaaagacatagataagaagaaatttaccaaaaactttgagatgagttatctctgggggttgaaatcatgagattcatgtttctttctttgtacttctctgcattttccacaatttcctcaataaacatgtattcttttaatagacagtatggcaaagaatatgtgctttagaggcaaacagactttcaaccaaaccttggctatcccatttgttattctgattttgatctcagttaaattctcaaagcctcagttttctttaaatctgttagaaaataataactcttgggatgttttgaggattaaatgcgataagtttaaagctcttattacacagtagccagataaaacatgttagctattactaatatctaaatattattaaaataatatgaagtcatacgtataaacctacatatgtatgtatttaaggataattttaactaaaagctcaactctttttgcctcaacaatttcctcatgtgatgtcattttcctttttctttcttcaatatctataggctattggttttcagttccgctattgctaagcattgtttccctggtaattcttctcgtcctaatctcaatcttactgtactggaaacgtcaccggaatcaggaccgaggtgagttgtcacagggagttcaaaaaatgacataaattaaatttgatttttaatgacaatttgtgagtcatttgaagatataaataagggaatggcaacaatgtgttttgtctgttgtttccaaaatacagaaatgttgatactgttttaaaatgcgtcggggcattttcttgcaattggacattaaattggacatttctgctttttgtttgctaagatgacttaaaagctaatgaaatcaaacaatggtgatagaaccaaagaaagaagtctggcacccacacaaggccctttccactcattaatgagaaggacaatctcttctctttttatagcacttcacaggccatctgcccatttaagaggctgcaattgtccaattatgatcactcattaagtagcactttctgtgttatactcccacgatgcctcaaacactgtcagcatcatgcaagtgatccatacttacagtaactgtgtcatgccattctgcccttctagactgtaaatttctctttatctttcacaactatcacagcatcttatatataccagggtctgaataaatgttaatttactgaatgaactgattgaggacagagagaatttttaaggtgattttttttcaattccttttctcctattgtaaattcagtacctcataaacgccagtctaagatattgtgagaaattataaaacaagagacactataaagcaagagcagtgagctagatagagaggaagaatgaaatgtctttggtttctgtagacaatgcataatttattgaagtgaatacaaagctgcagtttatgttttgtgtaatggaaatttgctagggtgaaggggtgatgtgggagtttcctccatttcagatgactgaaggataggggtcaggaaagaaaaatagttggctttgatagctattttagactttgattaaaaatctcactcattttttcctttcattttatgttttatagaaatgtttccttttagttttatgtttatatttttatgtttttgttcatgtttcaagtttttgaccactttattttgcataatcctccagattaattcttgtgaatttataaaacacccaaaaagccttcagtgtcagtggcccttttgcaaaagtaggtaaaggtatttgttctgtccaggagagaagattacaaatcagttaatcttactacacataattataagcctgtggaactcataagtgctccacagaataaaatcaaagacagaagtctgtttgattctactttatccagaaatttttcttttccaattaggaaactgaagcccagagaggaaagctgacttccttccataagtttatacagcttcttaagagcaggctaggactaaaccccggtgccctgacctctgccaaatgttcttcctgtcattactgatgccccaatgtcttgacttgaaaggagctattgttatcagttgcattcacttaatctgtgcttactgtctatgcccttttcttttggaaagtgcaagcagacaagtataaagtatttaaattcatttttaaaagtccctcttgggcaaaagttttataatgcaatctactcaagcctgaggtaaattctactggaaagagacatgcaaaataattacccttgttcattaagcaagtcttggattttctgggaaatatagtcattcaatgccaatatccgattcttgaagcaaaaagaatcagcttatttctctgcccaagtttttcctcacttatgaaataaatacctgaacctatgttgactcctgtacgcatcaggattgccatttactgatgatgtcttcatgacatatggccaattgcattaattcctctgaatgactggatttttgactcatttcttttccatttgtgttgcttacaaaagttacctgaggctgggtaattcataaagaaaagaggtttatttggtttctaaaggctatacaagcacagtgccaacatctgcttctggtgagggcctcaagctacctccactaatagcagaaggaaaaggggagccagtgtgtgcagagatcagatggcgagacaggaaaataaaagagggtgctgccaggctgttttaccagctctcatgggaactaacagagagagaactcactcacaccaagggcattaatcaattcccaagagatcttccccccttaaacacctcccattaagccccacctctaacaccggggatcagatttcaacataaggtttgcaggatcaagtatccaaactacaacaactgatttagaaattttaacagccagataatttggcatcatacacttacagctagtaaaaccaagagtcaattatgctgaagcttaaatgctcagggctaagaaaatactggttcatttagaccaaacttcaggttatacaaaaagttgggacaaagaaaagagaaaggacagaaaatcatagaagatagtgacactttttatttctaccattaacaaattctgattgatattttgtgaggaagggaaatagtcctacacatttgccttccagttgttttcatccttacttttcttttctttctctttttctttccatcatctgaaaacataaaatttccaaatgagcaggaaaacacgattggtccaaaataatacaaaggttttgaacttggtgacctcaaaaatggtgatgtgaacagaaacactaaagtgaagaggtggaactgagagagagagagagagagagagagagtgtttagagtttgtagaaaagcaaaggagacagacgaataagtttttgaatttattgagtgtgagcagacaaagaattatcttcatgtagctgtccagtagccaataataaaaatctggtaagtaaggtaagtctgttaagtaaggtcaattctgtgttgggtaaatgaccaaaacagaagtttattttaggtcataatcactactcattgctcacaaatgcctaagcaaacttacagttactgatgttatttttacgtagaagttagacgaccattacttttcttgtgatcctgtataatgccagagagcatgacgttggttttttccaactgcgaagtagcacaggccatttttctgcaccactcctgatagaattatcacagttacttcccaggagactaccacagtaagactaataagatttcaaagagcattcttttctctttcatgaatccagcactttaaaacagtaagtgagaaagaattaaaatttcctagggaaattttccaccatctcgaaatacttctttctattaaaacccagtgatttcataaagttgtgcctttcacatatatgacaatgtagttaaatttggagttgagaataatcttttatttctcattagtcaacccaccaacaattacatgcttctcagaaacaataaaagaaacttcactttgaggcagatcatcatagacaatcacctaatttttaggcagctttattttgtttggtttggtttgctttgctttggtttggttgagtcaaggctgctttggagaacaatagaaaatttagacaatcatgtaaaatttatatgccaaacttcacttttttttcaagtactagctaatccatgtagaaatatgtttttcatctgcatgagctgtatatttatcttgatttccttctcttcacaataacctaacctatgaatgggttcctgacaatgtataataacaatggcaaagttaataaaacgtcatttcctggataacagcatgtgactttctcctattttaagcttaatacttaatacaaacaacaaaggtgttcgataaacaatttgtgatgatgtaattggtcattagttgaaaggggaaaacaaaaaatatctgttcacccctcctgaaataacaacctttgctttgctcagaaagcacttttgcttcccgtacaaaggctgtatgaatgggtagccctctgtccgggctgtatgaaataagaacctttgctttgctcaaaaagtacttatgcttccctgacagaggctggatgaatggcactacccaaccccaccccagtatcctcatagttccaggaggaagaaatgtgatgctttacatgagaaaagcgataaagaatcttcattgaactgcttagattagtattgctgggagaaatcttgaattccagggctatttttccgcaaaaattttacaaattttgggtgatttacctatcatgccaagatgacatacataatcttatcacaaaacccttagcaaacagattcttaatgcctggacattcttgcctggagctgttctttgctgttctctctaacatctaaacccacatgggcatagatgacccaaattttaagtttcagtctgtatgtggggaacatctctaggaatcaagacatctcagtctcctgcccaataattcaatgtgtgttcagtcctcaaatggcatactcattcccttggctttttggccatggggcttttcaaggagattagctgtcagtacctgttagactaattaatgaaaaacaaaaaggatgagaaaatctaccagctgaaaaatcctctaacatctctgctccttttgcattttagtttgcatatatcctttacctagtgtctattaccagtttgttttgtttggaaccgctgtgcatttcagtagtatagtcacacccatataataagcttgcctctaaacagatacaaggccctagcctctactaacaaaagaagccaactgtatgctatttaaactggaaaagattgggccacttaatgaaagtactcaacatggcttacagagggggaaacatcataaatgctgtattaattttctattgcttctttaccaaattatcacgcacttagcggcttaaaacaacacacatgtattatactacagttctagagatcagaagtccaacatgggtctcactgggtttaaaacaaggtgtctgcagggagacattcctttctggaggctctaggggagaatcctttttttccctctctctcttttcctgcttttagagactgcccactttccttgccttgcatcttcaaaaccaacaatgtccagttgagtctttttcacactgaatcactctaaatctgaaacatttgtctcctttttcctttataaggatccttgtgattacaatgggcccaactgcataatccatctcagggtccttaatttaatcacatcagcaaaattcctttagccatgtaaagtaacatattcacagattcctggaattagaatatggatgtctttggggtgccattattatgcctatcacaaatgctaagagggtgtgggagtgacttacttagagggacagctgtttactgacctcccagtggaagcattctctctctgtaattccatagcctttgctctgttcctggcaactctctatcaaagaacttcaaaacctggtcagaacctctgaccaggcaaggctttattttccaggattatattttgtctctcaaatctgtaatgcaaaagcatcacttctgctttcccttgttttctatcactaactataatattacaaaaactttttttttcttagaatctcagttcttgcatatttcctgcttctccctattcctaccttttcatagaggaagcaattctgacttcctttgtcttcgtcataagcatcccgtaaacacaagttcacagggaactgtgaaagttcaaagtgggaaaattatatttatcactatgtgtggtgatagtaggcataaccaaattggtctttccccgcttatcataacgtattaaaccgggaatttctcagtccctaatacttgcagagtcatgttatgaggtcattatagattttaggagcctcaatgcttttcatatcattttcagaattcttcaaaattcccatttataggccctaattgatttcagcagcccagatgcagtagagcagttcttccactaacaatttttttaaagacagagctaaaaatatatatatttgatgaagtatattaagtagaaaaaaatgttagaaatatcagaaaaaaattaagaaataaaagtatgttcagtacaatttaatttgaataattttaatctctaaaaataaccatattgtaaaaaaatacaatttcttctagtaaataaagaacaaatgagattttgtactacaaacatgcaagacatgttttgcaaaaatcacaacttcaatgttaagttccgcatttcatgaggcacaattatggaaatttatcaatgagaggctattaaaagagagcctcttgcccctctcagtattcaaactagatagaatttcatgatgactgaccaatgctgctagttctgagtctccgtggacactagtttataaatactccaaccttctcccttttttatacaataaagagaaatgctagccttgtgttttgaaagtcctttaaagagttcatgttaaatacctttgggattatgtacacaattgtcttttaatcttttttaaaaatattacttattatgaatttttgtttttatttttttaattgaaaacagaaattttatgtatttatggtgtacaacatgatatttctatatatgtatacattgtggaatggctaaatcaagctacttaacatgtgcattgcctcacatacttatttttttgtggtatgaacacataaaatctactctgtcagtaatattcaagtatacaatacattgttattaaccgtagtcaccatgttgtacaatagatctcttgaagttattactccttatctaactgaaattcttttcatcttaaccaaggccacatgaaataagaaactgaatgtgatatttatttctacaatatttctccttcaagagtttaaagttttcaactgttaattttagcaaggatgattgcaaatgacatataaaattggttgttttctagtcagtcatttttatttgcaacaatgaacaattacttagcgattttgatcaaatcctgtcctttacaaactagctgagtacctttggacaagccatttaacttccctgtgcctccttttcctcactgagtaagatggggataataattgtaactgtatctcataagaatgttgtgaagatttaaacgggaatacatacaagtgcttagaaaagtgcctaatggccgggcgcggtggctcacgcctgtaatcccagcactttgggaggccgaggcgggcggatcacgaggtcagaagatcgagaccatcctggttaacagcgtgaaaccccctctctactaaaaatataaaaaattagccgggcgtgatggtgggcgcctgtagtcccagctactcgggaggctgaggcaggagaatggcgtgaacccggaaagcggagcttgcagtgagcagagatcgcgccactgcactccagcctgggggacagagcgagactgtctcaaaaaaaaaaaaaaaagaaagaaagaaagaaagaaaaagaaaagtacctaaaacgaatgatacgctggaacactggcctgggaggagaggggcggagtgtttatttgtagctgtcgccaacttccgtgaagtaaatgttcccaccatagcaaatttcaagctactaacaatttaaccatcagcgtgagccaataaagctctagcacaccaatgcggcagactaagtttgtaacagatgttcatttttgtaattactaaatctaaggtcctttttcgttttatcgaagtatattttcatgaattgtacaaatgttcaaggaaggacgagtttagagaggtaaatggagggacaaacaggaattgtagcagttaggacagctttgaggaagatttcaggttatctgaatctgtttggacacatgggcatgcgtatttggaagggagaagaactcatacagtaagtcttaatgtcatcaataggttcttggaaactgcgagtttaagcaaaacggcatgtaacagaaccaattttaccacaggctaaatgatagaaacaagacttaagttcctatggcatatttctagtcacaaaaacatcaccaaacttttaataaagaccaaaacatttctaatattaaacattgaaataaatgtgagttatgcatacatttaagaaacagtaacaaaaacaagtgagataattattcactcaatgatttcagttcaagggtatgggtggccagagcctatgcagctcaggatgcaaggcagacactgacaccagacaggacgtcatcccagagcagggggcattcacacacgcgcacacacacgcacacgcacacacacacagttactcagactgggaccatttggacatgccaatttacataacatgcagtacgtgtttgggatgtggggggaaccagagtatccagagaaaacccatgcagacttggggaggatgtgctaactcccacacagtggtcctggatgggaatctgttgtttttctcatcaacattataacaacatgttgtggaatgaaaggatgttgttggaggacctgctatataagtcatttcagtagcagtcttgggagaaatttgtggggacccactggggagacagaatcagaaaatgtgcattctaaaaacgtgcgtatactgaaatgaacttgtgatgcctagatgaacttgtgatgccgaaaactgatttcctgctagtgcagttgtatctctttttgaagaagagaaactgttttgcttagacattttttttgtaggagtatgggaagaaaaattactcactgaagctagtgcgagtcaagggtagagggagggcagttcctgtaaggatgtgtataaatggatttccaggaaactaaactgccgcatgtcaggaagagcggctacctgaaggtgcttgtagatccaaagctgccctaggttccccatcagcactgattcatgagttttgcatctagtttctcctgtccttaccacaacttggctgttctgtcttctctgcactaaacaacttcttcactctctattccatatgttttaaacttatcttactatttttgttccctcataccttgcttcatagattacccaatccaacaagaaacaaaagagagaaagaaagaaaagtgagaggaaagaaagagagagaaagaaagagagaaacaaaacgaaagtatattcctgaaccacacaaaaagacaaagaatcacattctctacaagtgtcctgtgtttttgcaaattaaccggtacttcaggtagtccttaggtattctagagtttagaagaatcctaaaaggttttgctctggcaagggctgtgagtaaagcatggcctttgaggcgatggagggagaaagatatatagaaactttattttagagaaaggaaaaacttcttcagaccagatgcagaatcaagtaatcaaccattcaaagtcaggcttaatttaagagctttttttaaaaaaaacagacaaacaacaacaacaaaaatgtatactagtgatctttaaaggaaaccatgctatcatttagattattattctggattccagtcagtagttaggtcatataagaattataaattctgttattggtaattgatagttcaaaatgcatagtctcaccactcagggaaaacagcacttagatttcagaagataaaactttgtaagtggggatgaaaggagggcatggagggtgttcttaaatatttaaatggatgttcatgagacaaaaggactagacctggaagttattacatttaattctcatagcaattgataaggaaagtatttccatctgataggtgataaaaccaaattcacagaagttcaattcattcattttataagtatttattaataatttttaatatgcttggcattgtaattagcactggttattatactataatgaacaaaacaggaccttgtcattttaatggagatgacaggttagggggacagcagagaaatgacaagtgaatcaacaaataaggatactattaaaacacgagattttagcacaaggaaataatatagaataatataaaatatagcatgcaatgaaagaggataacttgaaaaggataccagttacttggattttgttagggaaggcttcgctgaggtggtgacttttaatcagagaccttcaaggagagaataatccagccatggaggagacaagggaagagtggtttttagcaaattaattgcaaatgtgaaagctctaaggcagaaaagtcattaatattttacagggtgcggtggcacatgtctgtaatcccagcactttgggaggctgaggcaggcagatcacctgaggtcaggagttcaagaccagcctggccaacatagtgaaaccccatctctactgaaaatatgaaaattagccgggcatagtggcatgtgcctgtactcccagctactcaggaggctgaggcaggagaatcacttgaacctaggaggtggaggttacagggagcagagattgcgccactgcactctagcttggttgacacagtgagacttcatctaaaaaaaatatatatatatatgtatatattttagagcagtgttactcccaatatggtctgaggatggttgcccatccaagaagtgttctttactagtctgaagtaaaataagtacataactgagaaaaaatgcttacactctatgataagaatttgacagtaattttatatctgttaaatctgataatttaaaaatgaattatgttattttatgtcatttttctagtaattcgtttttactattgaaattgaaaaatattgagccatgttgggagaagatggtctttccatggtccattgatatctgatgttagaaatattgggcaggatctaaaatgtgcagaactttgcaggttctggtaaacaattacctaagattacacagagagtgagaggtggtgccaagataaaattccaagtcttttacttcatcgtctatgtgccttgagaggtttccaggctcccagtatgtgccagaaagccactagcccttggaaaggcctctacttcgtgaccatttctaccctgacatccagtgagttattatccatcagaaacaaagcttacaaatagaatacattttgatcatttggaatttttgaacatattcctttacttgtagtcttaggtgattttctaaaccattatttcctaggattacgtatgcccttttatttttgcttcagttttgtttttgtttttggttgttgttgttttgttgtttttagagatagtgtcttgctatattgcctggggctggagtgcggtggtgagatcatagctcactgcagccccaatctcctgagctcaagttatcctcacgcctcagcctcctgagtagctgggactacaggtgcatgccaccatgtccagctatttttttttttatttttattttttgtagagacaaggtcttactatgttgcccagactggtcttgaacttctgggctcaaatgatcctcccgcctcggcctcctaaaacactgggcttacagccacaagccactgcatccagcctacttttgttcttgtaaagagtcatagtcccctcacaccatactgggtcagaaatgtctacttctttatctttgccaatgaatatacactagaataactctgtgtttcttaatctctctattatttatcttcttaaaatgtattatgatagaatttacaagtgtccaaagttaataccttgtttttcttttatccagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatagcaagattttcatgtgttatttaattctgtattgtttcttatatttgtagtaaaatattgaacaattaaaagtgttgactcc

SEQ ID NO: 37276 - DNA, 29683 bp, Homo sapiens; identical to SEQ ID NO: 37275

SEQ ID NO: 37277 - DNA, 206368 bp, Homo sapiens; identical to SEQ ID NO: 36424

SEQ ID NO: 37278 - DNA, 8585 bp, Homo sapiens
gccaacttctccagccggccggggcgagcgccagcgcggcgtccggggcgagtgagtgcggggcgggggcagcggccgggcgcctgggccgccggtcgggccacctgctgcccggggaaggatagcgttgcgagagtgggacggggtgccccgggaacccctgatccacctagggcagagggcagcgagctacgggccggactcgggcactctggaggcgggcgagctcgggctgcctggggaggccgcaggcgatggcgtgtgcgcggctcgcggagcttcctagccgtgcgcccaccccctctgccttggaaggaaaggggattctaagcccaagatgccatcgccccccatcccgggcatgctttcattgctctttcctggcgggatcgagtactgtaacttctaggagccagatccccgccccaggaagcgcccctacttggagtcctcggaaactcttgccccacccgcttctgcgctgggcccccgggccggctgggaggggcggggccggctttccagagggaatctgcaaacttatcccgctgcacgccccagcctcgctggcttgctgtaaacaaggaacccgggggagtgcggagggagaaagagcttctcccaggcctcaccctactgcacacaccgacttccttcctcacgcctgtctctctttcctggttcccacccgtgccaggtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggtaggtgtcccagtgctgggtggtccctggggagtattgccccatggaaggatagggagtaaggatgactgggaccctctccagggtccgtcccatgccttcaatcctcccatgtaggcctcagtctttccatcgataaaaccagaaagtggagacaaacctaaaggctttttcagcttggatgcacaaggacccaagaatgtgtcctcatagccatgtgctaagaagccacctagcatctgtgtgagcagaagtcactggtgacatgtccaccacctccactcccaggcaccagctgccccacatgtactaggatatacctaagggtgtcatgcccctgagccagcgtttgcattgctgtacagaaacctcccacggacacatccagcttctccaggcctctctcgtcccgcagaaacccttatagacatcaacagtgtccctccccgcaggatccccctctccccaaatctagctctcctggggcccctgcctgctgtttgcaaaggttccataacctttccaggcagctgcagcccgtcggcagagttgtaacagcagctgccatttcatgccagacacttggcaccgcattatctcagcgaacaaagctcaatgcccctgttttggcagcggggggtggggggactgagatgccaggacataaagtggtggaaggcaggattcgaatccaatgctgccttgtttcaaaccagggctataaaccaggacgcacccaatgctgccctacccctacttcccagggccaggagggagtcccctctgctagttgccccaggaaggcgactcagaagttcccctcctgtggaagggaaggccaggtggattggatactgcttgagggttggggagagcctcaggagaggaaatgctgagttctagaacctcctagccagacagaacctcggaggtcttcccttttctagaggcaggactgccgtctcgctgccatcactcctgctgagtgccctccagtccctgcctggccatttccaggagcagggccctctcttgtctctgggcacctccttggtggctctttcctcagtcagagctccttctctacagaatctaactcgtgtgcaacattttgcctgacttgttgaaaaacatctcttcctgtctgtacctcctacagagagaatgctgggaaaactgttctgcacactcttagagctggagggcctgaacggtgacctcacctgacagaggggagactgaggtgcacagaggcaggggccaaggccgcatagctagttagtgacagagccaggacagcagggtctctgccctttccagcgcagctttttccaggccccatatttttcttgcctgcttgctctctgaaggtctggagttgaagattcaagttcatttggcacctcccagagaatcctggctgggaacgcctgcagccctctcctggccttggttcaagacgcctcttctccttgggatttaagctgtcatgggggaggatcagtggaattggttctcttgctgcttcccagcctgccctgaagcaacctaagaaataagtggaagggacagcttggaggtgccaggcccaatgtcctcacccattttacagatgaggaaactgaggctcagaggaggagaatggcctgcagtgggtaatgcctcctgaaggcccgggatgctgaagttcctcctctgtaattgtgttcacacctccttcagtttccctcaggagcatcagggaacatggattctcatttcagctcagccactcctccttggagtgacctcagtccagttgcttggcctctctgggtttccttatcataaaatgagaagagtcacgccagccctacccacatgagtatgcatttgtttaaatgtagcagtggcggccgggcgtggtggctcacgcctgtaatcccagcaccttgggagaccaaggtgggcggatcatgagctcgggagttcgagaccagcctgaccaacatggtgaaaccccgtcgctactaaaatgaaaaaaaaattagccaggcgttggtggtacgtgcctgtaatcctagctacttgggaggctgaggcaggagaatcgcttgaacccgggaggtggaggttgcagtgagccaagatcgcgccactgcactccagcctgggcaacagaacaagactctgtctcaaaaaaaaaaaaaaaaaaaaaaaaaagtagcagtggctggaaagggatttcaagaagggtaaggaacgatacaaatcctggagggtgtggcacttcccccccaaccccctcctccaagaggctttgctggcctcccatacaagatattttggggacacaaaggcacatgaggctctgccaagtttatggttcccagcgtggtgtgggatcagggaggcaccctgtaggttcagcggtccagatgtaacacacaggggcatgggggtggcagacctgggggtcaggcattggccctgatcatctctggaaggaatgaccctaaatggagcgagaagcagagcttagacacctggcggccacttcctgctcaccttaggcaagcgccttcctctttggctgtagttttgtgcctccacaagctcttagtcctggagtcagccagatctgaggttccatccaggtgtgatactgatgcttagcctcaggctagtgccttcaccgctaactgttgttcgtgaaaggagcgctgctcacctgagaggagggctggaggaagtgagagaggcagagtaggagtttatccagcccagtttctttatcgacttaattttctttgcctcccttcttggagggagtgagggtgaagaagggaggagggtatcgacccgctaatgagcacttttatttacagaacgctttttatatagtctcttctggacacctacagcagccctgcaaggggaggcaggcaggggtaggtaggctgggtcccactttgtgggtggggacaaggaaggggcttctctgttaagacaaagtggcagagacttgaccccaggtcggcaggcttcaagttggggctgtttcccaaggctactgctgtgggtggggtgagctgtaagcaagcccaggggctgagggaaaggtcacggctccatggtgtggctcccgggctgctgtatgggactgaaaatccactctgcctatctctccctcccagggctgggagcttggctgagggaggagggaaggtgcagggctgcctcttcctggctagggttaaggggttgccttctggggctgcctgctctggattccttagtaaaaggagaaagcgccagacagcttttcctggccttaaaaatccacacctaccagtggcctgagggatgttaactctagtagttgagtacaagaggtcatctcatccattccccagcctcagtctccttttccagggaggctcagggtggtcaaagaacacaggcgttgggggcagaccaatcagacttacctttgctgtgtgtcctgaggcaagcgacatcacctctctgagcctgggctcccccagcaatgctgagagaataatctcccctgctttgtgaggattgaggaggataaaattcttgagagcacctgctgtcaagtgcctggtgccgcaggttatgggaatgggggcatgcctgctgggggcagggagagccagaagccttcagctagacttgggaagagaagcatgggagcctctgctttctggcccaacgtgcctttccaccaactggctgttctttttgtttgtttgtttgttttttgagacggagtctcgctctgtcacccaggctggagtgcagtggtgcgatcttggctcattttaagctccgcctcctgggttcacgccattctgctgcctcagcctcccgagtagctgggactacaggtgcccaccaccacacctggctgattttttttgtatgtgtgtttttagtagagacggggtttcaccgtgttagccaggatggtctcgatctcctgacctcgtgatccgcccacctcggcctcccaaagtactgggattacaggcgtagccaccgcgcccggccaaactggctgttcttgaaagttctctggcccaggttcatctcagcccttcccacagttcatttaaatgccccagacaggccctgagctccccttgcttcaccccgtccagctggcccagtgtgggaggcccgctctacagaaactccctgacttcatctttactcagaaggggtgccctttatgtaataagaagaacacagtggggctgtgtcatcagggatggggacaacaaaacaggattcaacccgttgtgctttcaaatgcacttcaatccagcccactgtggaaacattttaaagctgggtttcttgggaaagaatgccctcgatgccagctgatccattgttcctcgttggtagggtgggcacacatcttagattcaagtttccaggcaaagcaggtgaaacacaacaggaagaaattgctctaattttatacgttatatgcaatcaaacttccttttttaattcattattattatatttttgagacagagtcttgctctatcacccaggctggagtggcatgatcacagctcactgcagtctcctgggctcaagtgatcctcctacctcagcctgtcaagtagctgggactacaggtgcatgccaccatgcctggctcattttttttttttttctatagagatggggccttgctatgttacccaactcctgggctcaagcaatccttccatctgggcctcccaaagtgctgggattacagatgtaagccaccatgcctggcctttctactttattttcaggctattcaagtgaagcagtgggagtggagaaggaagaaagaaatctgtaactggtgatcagttgattgtaaacaccactgccaatcaaactcgacttgtactaatagattttggaatcctctttggccccggggtgaaaggaccaggacatagctggcgtgatgatgtaccgaatcgtgtgcctgccagggtcactgggtgcttttagctgcagtagttagacttccccacacacctgtgaggtgggtgaggtttactttttttttttctttgagacggagtctcgctcttgctgcctaggctgcagtgcaatggggtgatctcggctcactgcaacctccgcctcacaggttcaagcgtttctcctccctcagcctcccgagtagctgggattacaggcgcatgccaccatacccggctaattttttatatctttagtagagacgggttttcaccatgttgaccaggctggtcttgaactgaccttgtgatccacccacctcagcctcccaaagtgctgggactacaggcgtgagccactgcatccggcctaggtggggttttgtccccgttctgcaggagggagactgaggctcggaggttcagggcctgcttggctgtacccagccccagtatatgccttggccacactagtcagatccttcccctcccactcctgccaccctgctcctgccctgtcccataatccaggttgaatgggggtggggatttggggagcaaggagggctcaaagagatggagataggcctgtgtcaggccaaagtgcaggttgggcactgggagtggggccaaccatagagcccccacccctgccagggtgtgggctgctcgaggaagacaggagtggcctggggcatgtgtgagattggcctgtggcctcaccctgtgggtggcaccagctctggccatggctttcccctttgccccaattcctggctcttctgaagccagatttggccgagggccctcactgggtactgagacagttccagaaaggactctagagccagccgagtccctccactctgcttccatccaagttcttggaggggaccaaaaaggcccacactgtccctattctccccctaccccctccatgggtggtgaagtggctgggggcgcagcatggcagggtgggtgggccagcctccaaagccagcgctttccttgtgccacccgcttcgtgcagcagccaatacacagtggatactctcatttccatttttcctatggagaaactgaggctcagagagctgacataacttgctccagtgggatttgacctcacatctgacaccaggtcacttgctctttctgcaactgtgtgcttaacagaaaaccagaggccccgatgtaatcctgggtctgccttcatctttctgtgtggccttaggtgagccgtgttgttttgccaagactcagcggattcatctgtaaaatggggacatatctgattagttatgtggttatctgtttagcatctgcctttcttgttagactggaatctcccagagggcctggctgtgtctctgcctttcaccgctgtgttctcagcacatagcatttgcaataagttgtcccatttgctcttctcaacatggctgtgagataggtatgtaccactgagcccattttacagatgagaaaactgaggttcagagaagtgaaatgatttgcccaaggtaaaggttagtggagctgagactcatgccgctgtcttctcaagcaggtgtgattttgggcatctctacttcaagacaggtgttaggagaggagttgcaggcatcttaagtcatgagaaatgataataggtggggctgggaataaattgagctccaagcagagcaaagatgttatttttatttgcaaagctatctatccttccagctatagctgatggaatcctccaggccccattagtccccacccctcatacatcccctaagctgtgtcctctgccctgcccaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgtttttagaattgctgtgcaaggctcaccctctctctgtcaacactggaataaactttgccttttctg

SEQ ID NO: 37279 - DNA, 17001 bp, Homo sapiens
ggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcggctcccgcgttccctgacctggtgctacagccccaccctctcctctcccgatgtgcgcactccgtccctcgtgcttggattggctcccggggtagagccatcgcgtggcctgcctctcccattggttggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgtaggaacgtgtgggaggagagggcactgcctcctcgcgtggccttgccaaacagggtcatgaggctcccctgctcgtaggtggttcccgtattacccgcaggcttgtgatgtccacgctctccgcctttctattgtaggttccttcaatggtgccttagctgctgttcctgtccaggacctgggctccactgtcatcaaagaagtcttgaagagggccactgtggctccggaagatgtgtctgaggtcatctttggacatgtcttggcagcaggtaagtctcagtgattccaggagaagtcaggcttattagaaacagcccataaacacacacacacacacacactctcacacactcacacactctctcactcactcaagttcttgcctccttgcttttgctcagagttccctctgttatgattcctcctgttggcccccttcttccagccctgtcagtagcttctatccagcttgagactcagcttcttggccaggcagggtggctcccgcctgtaatcccagcactttgggaggcggaggaggaaggatcacttgagtccagaagtttgagactagcctgggcaacaaagcaagaccccgtctctacaaaaaataaaatagccaggtatgatggcctgtgcctcccagctactggagaggctgaggtgggaggatcacttgagcccaggagtttgagactgcagtgattgtgtcactgcactccgtcatgggtgacagagtgagaccccttctctaaacaaacaaaaagacttagcttcattaatatgctttttgtgaatgaacttagaccactgacctacaccacctacactgccttttcttttccttttttttttttttttttttttttttttgagacggagtctctctctgtggcccaggctggagtgcagtggcgtgatctcggctcactgcaagctccgtctcccggtttcacgccattctcctgcctcagcctcccgagtagctgggactacaggcggcccactgccttttcattcttacgaagcagggccggccgggcccggtggctcacgcctgtaatcccagcactctgggaggccgaggtgggcggatcatgaggtcaggagatcaagaccatcctggctgacacggtgaaaccccgtttctactaaaaatacaaaaaattagccgggtgtggtggcgggcgcctgtattcccagctacttgggaggctgagacaggagaatggcgtgaacccgggaggcggagcttgcagtgagctgagattgtgccactgcactccattcagcctgggcaacagagtgagactccttttaaaaagaagaagaagaagcagcagcagggccagcctgacgcataggaaagtatgcctgctcctccttactacctcaaagtgtcactcattcaacaaaaatgtattcagttcctcctatgtgccccatactgtgcttagtgctgggagtatggttccaacaatacaggtaagttccctgccctcttagggctcagttctgagcttggaaaataggtgccacatcatgccccttgcaaatggggcatatcactccccagaggaatatagctgagtcctgagagtgcccccatcttctgattctttgggtttgaacactcgtaattaattaattaattattattattattatttaaagagacagggtctcactctgttgtccaggctggaatgcagtggtgtaatcaatcgtagcccactataacctcaaactcctgggctccacggtatcctcccacctcagcctctggagtagctgggattacaggagcaggccaccacacctggctaattttttaaatttttttgtagaagtggagtctgtctgttgcctgggcgtgagtgcaatggctgttcacaggcacaatcatggtgcaccatgcccttgaacttctgagctagctgggactaccggtgcatgtctactaagtttaaggcttttaaagcactgtgctaaatgctttcctttcattacctcatttaatcttcctcacaagtctgttatatcctattatcttcattttacaaatgaataaatgagagtttaagaggttaaatgacttaccagggtcacagtttgaagtggagctagcacttgaacttagatctgtcctattccttgagccagataccttctacaatcatgtaacaaatgtttattgagcacctactttgtgccaggcactattttagcagctggagataagcaatgttcatatcagatagaaattctcattctcatgaagctcgtagtatgctaaatgctagcattattaattgtgttagcacctcatttctttctttttctttttttgagatggagtcccactctgttgcccaggctggagtgcagtgacgcaatcttggctcactgcaacctctgcctcccgggttccagtgattcttctgcctcagcctcccaagtgactgggattacaggtgcctgccactgtgcccagctaatttttgtatttttagtagagatggggtttcaacatgttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtagagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttatttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaatgagaaaaaaaggtatttgtgaattctgagtttgtatatattttgttatataaccatttaagcatagtgtaatgaatactaagcaagaacagaactgcttattatcaaaggttttcctttttaagtaaccctttttcttctcaagtgtcttaagccatgatcttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaagcaattctcctgcctcagcctccctagtaactaggattacactcatgcgccaccacgcctagctaattttgtatttttagtacagacagagtttctccatgttggtcaggctggtctcaaactcccgacctcaggtgatctgccctccttggcctcccaaagtgctgggattacaggcatgagccaccgcgcccaactatttaagccatatcaaaagatgaggatgacacttctttcttaatgtattaatgacttatttatggaggagaaagcttatatctatgaaatacctacagagcagcacaaggcagtatatattcaagggctagactgtgacaggtggagagtgtatacaggcctttttgcctccagtgggcacttacttgacctgtaggctttcagaagtggcaggtaacccaactggcaattttccacacactttcactgtgacattttgtctttctccttgattgctaagagtcctctgtgttcctctttctaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggtaaggcctctctgatgaggtggctttcactgacctcacactgagaaactcatgtctatgccagaacagagtaaacagatgcatagcagagctggaaccaaacagtgaacaaataaacagaaatgacaaccttgatccctacttgaatgtgaagtattcttcagtttgggtgggaaatccgggttgataagaagtttatcaaccagtgtgattggaaccgaatatactttttctaaactattaatgaagcatgtaatattttctgaattaaattcatattagttgcttgatgtccttggttttaaatttctttcccattgtgagtaaaaggcaaaaaacagatgttgccacttaccttcctgcacatgacaaggagatcctggggaccagactttttgaccttttcagggtatagaacatgtaaaagaggaccaccaagtggtgcccttctccagtaggtttgccaggcatgatttgtttcaccaagttccatacctcaaactggcatagtggttgaaagaaaaactataccccctgcttcctactgatgcagctcaggggctgaggtgcagattccctagatagaagctgattcagcccagccattgctgaggttcaggaggaggcaggctaaaggtaacaaaaataatcggagtgattttgatgggatgatactgacatctgtgtagtactttaccaggtgcttttgtacatgtgttcacaacagccccatatagggtagatgataccattcccagtttacaggtaaggaaactgaggaccagagccagcattcaaatacaactcttccgactctaagtccaatcaatgactctttccattctaatatacctgctgttgagttggtgagagttaagactggccgctactcagaaatccctccccatcatttagttagcctgattattctcactgtagacattatgtcatccattgaaataggtaacacattgttagctttacttaagcccttagaggatttcttcatttaacagataattaattgcctcgatggaaagaataaatggaattcttaaggaaacaggacacagaatgggtaggtttgagggagaattgaaaatgggtaggtaggagagtaatcgttcccaacaataggaaagatgaagtctgctaattccaggggtctttagaccttggcctggctgaggacctagaactggggagaagggctgcaaaggggcctagatgaagacttaggaaatactagatagttttgagttgtattctggggagaagactaattgcaactaagcctaaatccatttttatttctgacttctaggctcctcacttggcttacttgagaacaggagtaaagataggtgagatgccactgactgacagtatactctgtgatggtcttacagatgcatttcacaactgtcatatgggtattacaggtaaggcagacatggctgaaactgtattagctttaaaaaggttaaaaagaccatatactaatctgcttcttaggtgctttcgtccttatggccagagactgtcttaaggatttttatatctcttctttgattaactgaagtgaagtaagtattctcttctttgtgaactcttgattatcagagaatgttagaagtgggaagtacctcagagttcttctggatcaacccctcattttaccaaatgaagaaacagggcccacaaatagtgcttctgtggcagaggtagtgacagagataaaccagttgtttttttggtacctagctgtactttttgtactacacaattgggttattggtcattcatgctgaagggtcctgtggtctaagtttaatggcaaagcaactgggaaatcaaaagcactcttgtctttagtatacatgtaaaacttaagaaacagaatagacattttagagttaaagaatcaaaccctgagaagttaagcaccttgctcaaatgcatgcagcaatggctctggttttatgtaacacataaatatgtgaaaaaggtaatggggaaaagtacaagattccaagagggaactgtgtgcatgaatgctaggaaggaaggaagggcttagggatatgggaagcaatgagaagctcaaggcatcttgaccacttctcgacttacagccacaacagagaaggctataaaaacacaggcagacaatggaagacactgtgtgaccaactgcctcaaccataactagaggtggtcattaaaaattcagatcccgagccctttccaaggtgtactgtggattgaatggtactcttccagcctccagaactgtaagaaaataaattgctcttctttagaaaaaaagaaaagaaaaaaggctcaggtcatgatggagtaattgacaaagattagatttcctactataaacaagcataaaacttgtgaaaatatataaagccactgttttatgtatgtcaggttttgactaatactcatgtaagactgagatccttgagagaagggaaaaccccactgtcactgtctctacccagggcacttcccaaactgtgttatggagaggcagagcctaagctggaaacagtggtctcagtgatctgaagaagcagagaatttggggcttctgagatggctggagtttgtggggcagaataagggggagaagaaaaaaagagctccagaaatctgcaaaaggttccccttaagtctttgatcaaatactaagcttgtagataacagcttacaaggcctagtagaaaagagctgcaaaggagaggtgaactggagattttatagattactaggagataaaagttctggacaagcgagtggaaaccttactgaactccttggacactccattgacatctcagaaagaccacagtttaggggtagggccaaagccatagagtaaaagctactctagacccaaactaataagcttaaaaacaagcctcaaaaggatcaaggtgatttgccagtattttgactgcttgtggaaacaaaactcaatatattctctaaagataataaaatctctatgtccagttatgtagcaactataatgttcagcatgcaatgagaactttctagatacacaaagaattaggaaaatatagcttacaaccagggtggaaaaaaaccacaacagtcaacagaccctgcaatactagaattatcagatgaggatcttaaaggctctattttacatatgtttaaagatacaaaggaaaatataatcttcatagaggaatagatgtggacatctcaggagtaaaaggaaaaaatataaacaagaaccaaatagaaattctagaacttgcaaagtacacaatctgaaattaagaattcactgggatggggccgggcatggtggctcgcacctgtaatcccagcaccttgggaggctgaggtgggaggatcacttgaggctgggggtttgagactaggctgagcaacatagttagacctcatctctaaaaaaaaagaaaaaaaaattctgaatggccttaacagcatcttggagacagaagaaaaagggtcaggaagtttgaagatagatcatatacacgacctgaagaacacagagaaaaataatgaagaataaatgaacaggccaggcacggtagctcacgcttgtaatcccagcactttgggaggccaagccgggtagatcatctgaggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaatgcaggcagatcacctgaggtcgggagtttgagacccacatgaccaacatggagaaactccatctctactaaaaatacaaaattagccaggctggtggcgcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcatggaataggaatctcatacataaggaagagagagaatggggcagaaaaaaactgaagaaaatttccacatttggtgtgaaaagaagttcaaagaccaagatagacaagggaaaaattacaccttagcaaattgtagcaaaaagttaaaaaaagatcatgccactgcactccagtctgggcaacagagtgagactctgtctcaaaaaaaaaaaaaacaagagtgaaagtgaagagccatttttagatgaaggaaaatgaattgcctgcacacctacactacaagaaatactaaaggagccaggcatggtggtatgtgcctgtagtcccacctactcaagagctgaggcaagagattgcttgagtccaagagtttgagtctagcctgggcaatgctatcatagtctactatgattgcacctgtgagtatctactgcattccagtctggttaacatagtgacacaacaacaacaacaacaacaaaagaatagcttccagccgggcgcggtggctcacgcctgtaatcctagcactttgggaggccgaggcgggcggatcatgaggtcaggagattgagaccatcctggctaacacggtgaaaccccatctctactaaaactacaaaaaattagccaggtgttgcagcaggtgcctgtagtcccagctactctggaggccaagggaggagacttgcttgaacctaagaggcggaggttgcagtaagctgagatattgcaccattgcactccagcctgggcaacaagaatgaaactccatctctaaataaataaataaatagtgtaaataaatactgtataaaatgcaaagcactcagaatagccaaaacaattttgaagtcagaaaatagcacttacatgctctgattttaacattacctataaagctgttgtaaacaagacaatgtggttttggcataaggacagagaaagagaacagagttcagaaatagacccagacttatgcttgttttcaacaaaggcatcaatggaatgaaatggagaaattaaagtcttttcaacaaatggtgctggaataacagattactcacatgggaaagatgaacctagatccctacctcacaccctatataaaagctaatttgagataaatcgtggatttaaaaataaaagcaaaaaatgtaaagcttctagaagtatatataagagaatagcttttacagggtgcagtggcaggtgcctatagtcccagctactagggaggctgtggtgggaggatcacttgaggccagcagtttgaggttgtatagtatactatggttgattttgcctgttagtagctgctgcactccagcctggtcaacatagtgagacatcatccaacaaaaaaaaaaaaaaagaaagaaaaacagcttgataagtaaagacaagacatagaaagcaaagcaataacttttttgtgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctggcctcaaactcctgagctcaagggatcctcccacctcagcctcccaaagtgctgggattacaggtgtgacccaccaaacctggccaattctcacatttgtagaagagagttacaaatacggaaagggagaagaatgtagcttgtggtgttaggttgcattttggagaactcaaaatgcagtatgaactcaaggtgttaccatgagtgtgtgtgtatatgtaaaattataaataatacatatggaagtttctactgaacagacctagaaacaatgacaaaccagtaacaacaagcagtcctgacacccagatcttctaaatacatttatccactaaaaggaactaaggttgtttggagaaatggccctttccaaggctagggaaaaaatgctaaaaaattaaggacatgctcagggacatgttgaaagcacacaggaggcagcctacggggcttccactttcctgtagtggaattttgaacaatttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgagagtaatgagttataacttattcaataaaatgaaaatgtatgagtccatcctgatataaataactgaataaatgggagaaaaggaaaaggttttctttgtggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaaggcattgtatctccaactttctctcagatggttcagaaagaaaatattaaagcaaatggagggaaaatataaatggtgactctgggtgaaggaaatttctgtaagtttacaattatatagaaagggaaggagagaagtatgactcctgagagtcactgcaacatttccaaaccaactgccagtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtgagtatatcatagtggtttaaacatcaacctatttataggtaagagtaacatctaaaagagtaatacataggaatctttagaaattatatcttagttatgtttttcaggttgcaaatatatgtcctggatacatgaatgtggggagggggtatgctgggtttacaggacacggtaacatgggacctatgtcagcactcaagcactcttggttccagagcgtccatgaccactgtgcacacacagcaggtttcatgagaagctggagcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcctgccagcagtgcacgattggctttgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaattattcttaaaacagtttaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcccctccccaactgctgtaatcctttttttttctttttgagacggagcctcactctgtcgcccaggctggagtgcagtggtgcaatcttggctcactgcaatctccgcctcccaggttcaagcaattctcctgtctcagcctcctgagtggctgggactacaggcgcacaccaccacaccggctgatttttctattttaagtagagatggctttcaccctattggtcaggctggtctcaaactcctgacctcaggtgattcaccctcctccacctcccaaagtgctgggattacaggcgtgagccaccacgcccagccccgactactgtaatcctaccactttctctagttggaaagttttgtggtcaatatattgccaaacataatttctatgtaaagtctgttgaattatagtaaatgccttagccaacaggtaaaatcatttaactcatgtcttcaggtggtaaagaagccacagatatgtaactgaggttaataagcatggtagaaattaagtcactcatattttacaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgtgagtataaccctattcccttttatgaaatttgtcttcctgttagccttaagtgagcttattcatgtagttagctctagtctttccctaccagaagagtaaccaagagcatttatttctatttttgagataaggtcttgctctgttgtccaggctggagtgcagtggcaccatcatagctcactgcagcctcaaaactcctaggctcaaatattcctcctgccttagcctcccattacctcgaactacaggtgcaccaagccttcttcatttcgtagagacaaggtctatgtcgcccaggctggttttgaactcctgagttcaattgatcctcttgccttaggctccccaagtgttgagatttcaggtgtgagccactacccccagccactgagagcatttggatcacatgctttctaggggaactgattctgttacattagccttaggtacacataacagatgctactggttcaaaattttaagacaatttagaatttctaagggatcttttagatcacacccttaaccttttggatggaatggatgtcactaaggcaaaaatgtgtgagaatgtcactgtattaacctaagaacaaaccaaagtagcagttaccagtatcatgcagcatatatttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtctctgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggtttaaaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgttaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcatt

SEQ ID NO: 37280 - DNA, 30263 bp, Homo sapiens
gcacagtccctctgaactgcacagagacctcgcaggccccgagaactgtcgcccttccacgatgtggctccgtgcctttatcctggccactctctctgcttccgcggcttggggtgagtccttctgaaatcaaaatgcggggcactttttgaaatccttgttctgggccgaggtgggcgcagatgcgtagaaaggcaaagacacaacaggtccggctctgcggcggggcacgacttccatattaggacttggacttggagcagctgagcccggccagcctggcccgcgcggagacgcagggagggtgaacatcctgagatcgccctgtactgctcgcccaaatgcaggccgacagccggcccacctcaggccgcacacacgagaaatttaggcagctcagtttgctgtcccttaattagtccccttacggctggatcacggagagcggctcaacataatattaagagcatcgactctggagccagagtgcgtgggttcgagtccccgctgggcgcttcctcgctgtgtgtccttaggcaagggactgcgctattccgtgcttgggttaccccctctctgaaacagaggtggcagtgctgcctacctcactgggctttggtgaggaggaaatgggtggctgtttctaaagcactcttggcagcgcctggtatgtagaaagcacgaaaaagggatggataaataaaggcgctgtttaaaaacgtagtgtatgaatagaaaatttgagctgtggtcaggccactatatcaggacctcttgccattaaaaagacagtttcttactcatgttctcaacaggagggggacaccagtgcgcggggcacaaggggaagcagcagagcctggggaggggacagggcggatctgaggccaaggggcttttactgtggcttccaaggatagaagaggaaaggcagggcaggcaggctgaggactggcaagttgggatacttcaggggctctggggcacaggggctgttcctaattgttttgtacctagccctggcatgattagggcaggtgggtagtggccagggcatggcaacccgatcaaagaggcagttggggtgtgggctctggggtggctggaccctgggagggagtttctccaaggtcaacaaggcctcagatgccagagcatcagaatacagaaagcaaaacacatggtacatagaggggtgcagcgaggggcctcgaaatacccccatgccattttatagacagagaaactgagactcacacagggaaatgtacttgcccagggtcaacccgaaaatcacgcctaggtctgtctctgggtcctgaatcctgacagcccagccccgtctgcatcctgtcttccttctggcagcctgacactgcgagagctctggaactgtggggaagggcagagaagagaggaagcctatttggaactgaatgttcctttacctctggttactcctggcaatgccatccatttccttccttaggaagaccatacaggctgcctccacttcctcagtttcctcctctgtaaaatgggcatgttgatgcctacccagcaaggcttatttgaagattaatttaaaaaactggaatgcatgcctggcacatagtaggtgcccaccatgttcgtgcttcatataacatcagcagcaactggtcttgttctcacacttgtttctgcctccccccattcacccactttttcacccttggcaatctggctgccatccacctcatcctgttgaagggaatccctgagctgagcatgaccagcccagtggtttcttctctgacttgactctcctccacctccctgaagtcctcagcactcttagctggttcctcgccctcttgctccctgggcttcaaagacatgggaacgttctctctcccctattctgatggatctttggtcttggccgtagtggtccctgtgtttgacctttgtttttttttctcttccctctcacactggcatcttcaatgaagccatacacatccaccgtatgtaccctcacagtccaggagaagattctgccctgctccctcaccaggcttccttccagctttgaagtgcgctcatcctgtggcatcatcttgcctggatatcccactcacatctccaccgagcctgtgtaaacagggatccagcattacaagccagctctttggtcttctttcccttccatttcccccacctctggtcagggaccaagtcttttcttttcctttcttttctttccctccctccctcactcccacttgcctgcctgcctgcctgcctgcctgccttccttccttccttccttccttccttccttccttccttccttccttctttccttccttccttctttccttccttccttccatccttccatctttcctttccttctttccttcttctctctctctggaggagccaggattacaggcacatgctaccacacccagctaatttttctattttcagtagagagggggtttcaccatgttggccaggctggtcttgaactcctgacctcaaatgatctgcctgccttggcctcccaaagtgctgggattacaggtgatccactgtgcctggtctccaagtctttcaaaataccttttagacatcatcatatttctacatattttttctttttttatttaaaattttaaaataattaagatgggggggaggatttcaggtgaagaccggaaatcccatacagtgctgaaaaggtggaaatcaccaagaaaacaggccacatgtaatgccaccacccattgctatgtcgataaacatgcttccaaggaagttcatctcagtattatttgtaattagcaacaacaacaaaagaaaagaagctaaatattgacattgcagggttggctattaataagatgagacatggatgctgttgtgtaactgggctttccataatgggtttccattgtgattggatattcccctttaagaccaaatctgaattgttctgttctgctctagccccacactttgagggaggtgttgacgtcttgtctgtatccaaagcagagcagctgggaggacaagaggctggaaatcatttcctaggagggaagctcagagaaactgaggtgactggagccagataggacctgaggggtgggcagcaagatcaagtgtctgaaaggccacaggctgcagatcagatcaggccagtatagtcccatgacaggtagaaccagaactgatgcggaggctgtgggaaatgaatttcagctcagtgaggaaacattgtccgtgctgcaagaatggagcagacctgcccagggccaccagaagaatcttccttgacctgatcacatcctttatctggaacggttcctgctgcttatttgtccattaaagaaaactcaagcgcttagcctggcattctaagccctccctgacatgtgcggtctcattccaggaatattttccactccccccagactccacctggtgcatgtgggccatgcccccttccccaggcaggctctgcattctgctgctctgagcctcagcaaattcccttctctctgctgtgtaccactctctgcttctcatctcccctcattcagtcctcccctgccgcaagtcccagctcctccatgatgcccgcaatcagaaggccttgccccctcttctaattcctagactgccttatgggtacctctcccaggacatggccacttccttcccagctgtagccccaggtgtatatgtgacccttccctataatggtcagtgcttgtgagaatatgggacacccctttttcatcctctcatccagcatgcggctcagtgccaggattctaatggataaatgtttccagagacttctaagggggaagctaaatgtcttgttctttcctagtagctctccttcttgcatttatttttagctggatgtttttatgcctccaattctagtttgcccattaaaccagctcaatgggttagggaggacattgatcgtcatccctattgtacatcaagagaaactgaggcctagagggtttaggtgacttatttaaggtcactcacttagaaagcggcaaactccacctggaatctgggtccagccttttgcctctgatgcatcctgatttattctccatgtccagcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtaagctgcggcatgtgtccttggggatgtttacctcaaagtgatgcaggaaggagtcaaggcagtcccctgacgggctgatcctttgctctggactccttaagatctttgtagatccttaagaacattccagaactctcacagcattctggagtccattatttaacacatgtttattgagcacctgctgtgtgccaggcgtgttctgggttcttgggatccattagtgaaaaagcaaagatccctaggttcctggagcgtgcattctagcagggggagacagataagaacaatatgcaaattactccgtggattatgtgatatgatagaacaggaaaagtgccttggaaacaaagaagcagttaagcaggtgagggagatcagaaggaaggatcccatgaattctgctgtcttgaattttgacatagtcggggagaggagtgggccaggaggtgtgtgggtggcaagtgtactgaggtgtccactcggcaagtgctcaactctcaggtgtgcctattcctgaggagaacaatggaaggtgtgtccattcaccctggccaagctgggaagaaaagcccaaaggttctaattggcctcaccatcactccccagggtaggaaggaccctacagacatcagagcagaccctgctcatctcagcagccaggtgttcggaggctttccagcagcccaccagtggccgccttcttttcttcccttttttaaaaaataatgtttactgtttttattttctgagtgcaaatgtaatatatacttattacagaaaatttaggaaatacagagaaaggaaagtaagaaaattaagatcacatacaatattccaccacccagagagaacaactatcagtattttagatggtaaagtattatgatgtaatatattgtttgtattccagtttttttgcctgttgatatactttctttctttaaaagggaatgctatattgagataatttggatgcctgctttgctcatttataagtatatcatgagcataattccatgccattaaatagcacagcctggtattaaaagctgcattacattgggtattgaaccataattaatttccccaagcttttatttggggtcattaagttatatatgatgtttttaataatataacatcatgaatgtgaaacatttatgcacattcatgaatagtttaggataacttctcagaaatgacatttctgagtcaaagagtatatatttcttgtttgatttccctcccaaaatattccaactacactcctcccattgacgtatgaacatctccatttggcagactcttggcaatgcttgggattattaaaaatatttttggctattgtataggcaaaataataataacaataccagcaatattattttcctctttaatttgcatttatctgaagaccagtgagttcttttttcctttcttcacattggaatgtattattattattattattattattattattgttattcctcttgcacttggtgatcttaggaaaatttcccaggatggaatcaagaagtcatctttgctggctctgattctgtcacttgagagctgtgtcatcccagagtctgagtgcctcagtttcctcatgtacctagtgggggcggtgatgactgccttttggtacattgaggtctgggactgttgcttataatatacttgtgtataagcaccacatggcatggatctacctggctatgtaaccttggtcaggttctctaacctgcctaggcttcagttttctcatctgtaaaatggagataatagaacctacctaatgggactagtctgaggcttaaatgagttaatatacaaaaggtacttaaaacagtgcctggaacactgggagaactaaataactattaccagtgttcatctatgttgcatccttgagatctttcatcagggcaacacaacagcaactgcctgggagaggcaggtggtagaatcttggcatgtcagggctgcaagactcatgtagaaatcactccgctcacttagacctggcggattgggacgcagagtgtaaaaggaattcacccaaggtcaccccataaatgcatgggagagacaaaactagagcacaattctcctgatgttgtcccacaaagatatcacccctgagctattgtgagaaatgtcacctcccagggaggatcagtgtattagtggtctcccctccttgatgctgggagttccaaaggctctggaaagggaagaggtgtgaagcccttctcactctgcttggtcttaggagaccttagtgagtcccagcgcccccacctgaagcccctgatagcctcctacccactacaatgtcgtgagtctgtaactatcaagtccatttccaggcttaaacctcccagtccaaggcgctgccgtagaaaacacctcgcttagatctggctgaacttcaggggttcttctttccccctccccaggtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtaagttgtgggaccccctggtcaaggcgtgtcagtgccagtaccccgcatcttctggggcagaatggaagggagtgaaggcagcttggggagggagctgcacaggccaggattgtttcagagaccccagggcctccacaggaaacactggttttccacacatcagtttaccctcgtgacataggcactctgggggagtttgttttgcatctttaatgaacatcttaattgttccaagttccctcatgctaatagaaggatgagaatgattacttttagttactagattaaaaatctgataccaagattgggtaagacatgattttcaatgttagtggtggaaagaacttagagaaaagccaacaccccaactcttccttttcaaatagagaaactgaggcccagacagggaaggggaggtcacccagtagggtagttttggctcaagtcttctgatcttcacatcagtgcttttgacatggagtagggcattgagcttgtatgtggcctttctccagcacagcaacattcatctggggtaactttcactgtccaggtacggatgttgggggcggagcctggacaatcccagaagctcttccttttgcctttggccaaatagctgggatttctttttgtacctaatttccctccctaattgtcttggcaaaggctgatgacccagtgagtcagaatttcccaaataaatgaagggcaggacatggggcagcccgccagctgcaggttggagggtggggagggtctgctggcaaaggaggcacccagggtgaaaaaacaaggggtgttgtgtctagccagtctcccaggggcaccgtggcatggtgcctaggagtgggggagcaggtctgcgaacgtggaactagaagttggtcctacatgtgctttgtgagacacaggaagtgagagaaaggtttactcattcattcattcattcattcattcattcattcattcttctattgtgtactcagtgccccatatacacagttagacctggggcttcagggaaaggaggaacatgaatccactccacacagcccctgccttcaaggatcttgccttctgggctgtagagacatatcctcccttcagcactttattgcaggccagccctcaggctcagtcttcacacaaagatgaatgcacactcaatccctccccaggaggcaggcagggattagagttgtgggagaaacaagggctctgggaacctggagtcaggagaacctccaggaatggccacaggctctagaactacacggtctgggtttaaatcctggttctgcttttgactagctgagagacttgggagtttcttaacttctctaagcctctgtttcctcaaaatgggaatcatcacatatgatcagtcaagggtgaccactaagcgtgatctcagtccctggctaaaaaggcagaggcaggctcatacccctgccctaacagtggactcactgcactgtggccggcgcctgcagtgtgctgggcagctcaacatgtggactctggaggcagactgcctgggttaaagtcctgctgctaccacttttgagttgtaggaccttgggcaggttaagtgcctccattttcccacctggataatgggacattattagtacctacccaatgtatagtttattttactgtgcttagaacagcacttgggacatagtttatgttacgagttcttttatatttcatgaataatattattacaatatcattattttagccactctcacttcttccccactatgtggacttttaaaatgcaagaatcatgcatgaggaattgtatccactctcatcctccagtattagcagagtccctggcacatgctaagttctcgacagtgttagtccattgactgaaggcatcctgaagtgggtgggttttaggctgggttctgcagggtggataggatttggggatgcagaggcataaggaggcatttgaggaagagacaccatcacaggcacgtgtgcttctcgagacaatcattcatgcacagagaagtttacttcaccaagagatagttaactgagatgaagctgagatacaagggctgccccatgggtacgctgagtgcatgaatagtctaggcttgagggtgatgggagtgtcctcccgaagaggacatccttagcctttgctatgcccatgatgatgttctcagcatcaagagcctttcggggaggaggcactggaggctgggtagaaaggaagggacagccagggtatgtgcagtagggtggtggcttgggtcccagttgggagaattatgcaggagagagattgccttttgcaaagttgctgggagctggtgaactttggatagcatcctccttcagttgtaaccaacaggtaggtcaccaaacaagacatcttctgagtgctccctggctctgtgtcctgtaactggtatgttgcttcctctctgcccaggtgatggtgtggatccacggaggggggctgatggtgggtgcggcatcaacctatgatgggctggcccttgctgcccatgaaaacgtggtggtggtgaccattcaatatcgcctgggcatctggggattcttcaggtaagaaatcggactctcctcactgcactttggcccccagaacgaggatgctaggacccagctcttgtcatgccagccctcaggggagcttagctaggttccacagtaaggcatccaagccccttcgtaattggacactacctaccctctcactacccagccactcatccacttgcctctgagcttttgcatgtgctgttccctctgcctggaatgcttattctatccgaagaacacctcttcatcctgcaagacccagcccccagttacctccactgaaagactcatctcctcttcacctatgtttctccagcacattgcttttctctgtcatgacacttagcagtcagcccagcaggtgaaggttgacacatctgacttctcatggaaaggagggaaggggcagagtcacagagggagctcagggcatgttgtgggtgaaggaatgggggctgcagatggtggggtgtgggagcatctgaccccttcctgtgggagtgttgggacccactcagctcattttctgcttgaaatttggcaagtgtgggaagcaaggatggagtcttcccatcaggtctccatggggacaggagtcagatctccttcaaggcgcaactgctatgaaccttttctaaggttctcctccatccatgccagtcaggtttcttcctgaacacgccactcagttggtctcattgcggtcatcaatgacctccccctgctctccacccaacctctcaggacttcccagcagcagcagatggccactcagcctctgtgacatgcttccttcccagcccctttcctggtcctccctcctccctgtccacaggcctctcttgtctccctctccctccttactaattcccagtgatcccagggagcagccagagcccctgtttccagcccacctcacctttgaagcccacaggcatcactcactccctcctccccacccctggctgtctaaagggtgccccactcttcccagggacaagttgaatccttgactcccactgcccctccccaacagagacccccttctcctcccaccacgcctccactcagcttctgctgccacatcctcccttgggctcaggagaaggccttgtggacagcccggactgtctcttttctcacaaccctcttggctgcgccttcagaatccactcagagtcccctactttgcacctcttccctggctcctagcccagccaaagctctctgtctgtcaccttgattatgatctttaacactttcagatccctgccacttttatataaagctgagttgcacagtagccagagtgatcacttaacacatgcattgaatcatgcgatgcctctgcacaaaaccctgcaggggcttcccatgctccttaccatgacagccgaagttcttgccaggccccagggccctctctagctgcacctcctgactcacactttctttcactgggccccaggccctttgcacttgctttttcttctgcctggaattcctttctttggatatttacaaggttcatgtgctcattgtgcttgttttatgaaggtctttgcctccaaaacctcaaatgtcactgcctccaaaaagccttccctgattgggatctgaaatggcaccccctgtcccactcctgtttttttccttactccattgtatttacctcagtgcactttgactacctgacatcattatattctctctatgtatctgtttatctgcttgtgatctgtagtgggaattcagtgtcatcacaggttttgcctgttttgctctcagatgtgctctagctcataagacagcgtcaggcatacagtagatgctcagtaaatagttgccagttgtgtgaatgtagaaccatacatcaccacaatgctgtactaatgaaagcagggtctcagagatgctgaagcccagccttattcttaagggttcactgagaacccctagccccatctgtggtcctgaaggtcctgcatgacatctctgctccccaccctcaacctgttctcttcctcacagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgtgagttttcctgtcaccaggcccaaccccacgcttgatgtgatgctgatgagacctcttggacacctgtcaatccagctatggatacctctgattacaatacctgaattcaggactggccctactcacagcccagcatcagggggtagaaagctaaagaccagctctccttggcccccaggaagctcagagctcagcttagtgtcctggggccatatgaatctccagttgcagcctgcaatggtggcattctcctcttccagcttggttgagctctctctctctctctctctttctctctctccttcacactcattttaacataaggactcacatcccttctcttgggaagtaggaataggcataaattatgagtaagggcaggcagagagaagaggtggacagaggtcattgtttggctaaaccagacctacatgtggaggggacatggacactgagcaggctgggaattcctctggggtggtctgatggcttgtccatgcccaagaaggaggcgacagtctttgtgactgtggggtccagtgggctaggggaggcaggcagaggaaggagggatggagccgcggatagggagggatggggcaggggttgtgggtcatagacacaaccttgggtgtgaggggtcctgctgggattggggattgggttcaggagacactgggggatctgggatgaaaacccagatgagaggtgctgggagctgtaggaagacttccacctccttgaggtgggcagagggtcagcccactactggattcctcagtcccgtgttggttttatagtggagtagatctagcctggaatagcgagtgagtcactgaccccactcctgagcatgaactctcctcccctccactctgctgtcaggttttgtctccattggccaagaacctcttccaccgggccatttctgagagtggcgtggccctcacttctgttctggtgaagaaaggtgatgtcaagcccttggctgaggtaggtctccggctggtacgtctccggctggacacccccacctccttggctctatgctcctgaatcctcagggatctctcttgtggtcggttgtagctaatgttctcctagaatcactgaggcaccaatggctgagcaggaagggcgaggagacaccttgatcagcgtcccagtttcacagccaggcaaaccgacacagggcttggaagggatttgccaagggcagcaggtgatcagggcagagctgggactccagctcatggccctagcagccagtacagtgccctatctgtgaccacactcctcctatgtgccagggcctggtgccatgttgggcagtgatggtgtcttgtgtctctctgggtctgcctaatggctggtaagtggaacaaccaggatttgaaagcagacaaggaaattcaggattccatgctctctatcccagctccacctcacatttcttgacacattcaccttgagatgattatgtccatttcaatggagataaggtagcagagatgagagattacataattgacccatgttacaattgagattagtaacagaggcaacgctccgtgggacctggaacccacacccacgggtctacagtatcttctgctgctccctgccactagtacaagttgggcttgggatagaatgccactttcctctttgatggagggaagggatgtcgctcttgaactctgttgttgcctgtgatctttgcagcaaattgctatcactgctgggtgcaaaaccaccacctctgctgtcatggttcactgcctgcgacagaagacggaagaggagctcttggagacgacattgaaaatggtaggttgcctgttcccgtagcccaaaccctgtaaacttggtcccagacttcttcatttcagctgtcctcttgcccagggacagtttcctgggacaatttctcaactctcagtatctgaatggggaatctgatttgtccttttttattgtaaaatgccacaaatgtaaaaaaagaaagtcaaaaaataacatgataaaaaattgtgtaacaatccccagtcctgaccaaaatttaatattttgccattcttgttttcagatgtatttttaagaaattaaatgttacatattcccaggggacaccatcatcctgaatttgggggatggagatattaagctcaaagattttcagaaagatgtcacaatttatcttggttgacttagaaattgtctgtattagacctagtggtggtccagttttctagattttctgagactgactcagttgtcatcctaggatagtcatccatccacccattcgttaatccgtctatctatgattgtcttatccatctatctgttcactaattcatccaattcactcatatctttttatcaatctaatgtcaacctattcataactttgtatttatctattttcaatccattcaccattcatggatcatccagccaccttatatctcaactccatcacccattcctccaaaatcaacaatccaattatcgcctgtctgctagttttcacccatctattcatgtatccattcaattcaactgtactccatgtattgaccaactccatccatccctccattgatccatccatccatccatgctaaatatgtaggggtgggtgttagaggtagcaaaacagacatgaagtggacatagtccctgctctcaaggaactatccaaagagaaatacattcatatacttcgcaggttgagtatggtggcagcacagaggggaagcattcattgtagtaatcagggatgcttcacagagaaggcggaggagccagatttgagaccagacagtggaattcaggagttcatgcccttaatcctgactccaccttatctttcctgagaaattcagctttcagatcattgtgcccattttaacagaggtaacaaagacagataaattttgtaattgccccatgtcacagttcaaattagtcacagaggcaacactgtaggacccagaaccgacacctgcgggtctagagtatcttctgccttccctgctccctgccatcctcacatattaggacttggggacctttaggattgttggatggccatggcagtctctcatcacagggaagaccaggaggacaaacacccagatgacacagcacccagggccattgggaactattccctttgagggggaagagtgtgaattccaagctcaggagtagcctggactctctccttggacctgaggctactcctggatcccagggctggcctctatcactggactctgcttgtgtttccatgagttgagtccaatgtggtattggtgcttaggtcttggctcaggctctaagtgaccaaagtgttcaaggaatgaaaacacaactgttttctaacgcccggaaggaggcaaatattccagcaattctgcatgtggcatcagaggacccagcttaaaagggaagagttgagtctttgggaaaacccatccctaagatcctagaacattcttttgagtttttctgagatcttgtggaagcacctccatgattacgcgctgcctccagtacacacacatgcagacacacagacaaacacacacacacacagacacacacacagagaaacacatacagacacacacacacagagacacacacagacacccacacacaaagagccacacacagacacactcatacacacacacacacacactcctggctagtgggacttcaatccttaatggagggacctgcactggttacatcctgagcacaggtcagatctgggaactacagtgcaacactacagtcactgcaatcttggtgaacacacaccaaagagaagcatggggtaggatgagactcagtgagcttgcgtgagtcagggctttctaatgggagatgaggaaactctcccaagtaccttgaacagaaaaagaaatgtgttgcaatagcatcgtcgtgtaaactgaaaatctcaggagttgatggcttcaggcatggctgggtccagatgatcataggatattattgagaatctaccattctctgtccttcagctttgcacatctctgtgttggcttcactcttaggcagatatatctcctgggaaggttaaagacaacagcactctagacttatgtcctatctgcttaaaaaccctctttctaaacaattcctgcaaaagttttggggtaaactctattggattgacatgagtgtatgcccatccctgaactaatattcatgttcagggagatggagcaccgcaggtcacatatagatatacgaattcacggagtgatgcgggaagaacctgacacctctgttgccccactcacccagctcagtgttctcctggtaagcctctcacccacatcctctgcctttgtcttcacagaaattcttatctctggacttacagggagaccccagagaggtaaggaccttttgtttctggattacgggttttgagtcttagcacctttaagctccaattaactgtgagtgaaagaatcatctcttgggtaattatagtaactcctgcgtgtttgtttctgaggcccagagaggggtagtgactcacctgggtaacacagccaggaagactagtggctggcctggaacccattttcctgactcccagtccagtgctcccaggcatcacctctgtgtgccctgggctctgcccactccccttcttttttacattttctgctccccaaaatggcactgtaggaggaggctgaaacagaaccttccacaatcaggaggcagagataacagcgatgattagccaaggagaggggaagcctaaatctcagtccaaggacactcgtctcctcccagcacacaggaaactccaacagtattctcccaatctcctcatccccactcccacccccacctcccagtgggttgacagtttctggtgacatcacctctgacgaatcttacaatcctgtcctctctgctgcctccctggagatcacagcactctcctaaatggtcatgggcggagtacatgagattcattcagcaaagacttaataaacacttcctatgtgccaggacttgtttaggagctggggatataacagtgaaaaaagaaagactccctaccctcttgggaccttccattacagtgccaggacagtgcaataaaaaagcaaatcaagtatgtattccgtttgatggtgtgcagcattaggggatagagtttgtgggtggcttcaatttaagtagcaggatcagggaatggttcaatgagaaggtggcatttgagccaagctctggaggaggcaggaagccagctgtcaggaaacctggagaagcctattccaggcagagggaacagtcactgcaaagaccctgacagaaggggccagtctggctggagaggaccgagtgtggggacagactggcttgaggctaaagaggtaatgggcagtgggagagagatcaattaaagtacttggatttggattcagagcaagatgggaagcctttggaggttttgaacagaggagtcacatgatcttagatctcacaaaggtctctgtctctggtgttcaaatagactgtaggaaaggggcaaagtggatgcagttgaccagctgggcagccactgcattgccataatccaggcaagggctcctggctgcttagacagggctgtggcagtggggatgggaggagtagttggagtctggatatctttgaaggaatagctgacaggatttgctgatggacaggatgcaaggggtaagaaacggggaggagtggaggacgccctgagttttctgacacaacaaggttgtgcccacacagggcagccacttgcaaactctaagtggagaacaatcacttgtcattgttgctgatggcagtcttccagcatggctgtcacccaactgaggtgctcccgtctcttgcctcaacttttagcctcttctacttcaccttctctccccatttccatgtctcatggtgcagccagactggccttccttaacagaattagagcacgtcacccccacttcttaaaagcctgaccttccttatgagacaaatccccttccctccatggagttagtccttcaaaacacacctgcgtgcacactgtgtgccagactgtgcagaaggtaggctctgcacctgtccctccctctagaccctgccccacagcatttctccaagccaagaactcttggttgtttctggaatttaccctgcacagtgacacctatgtccttttgctcatgcggttcccactgtttagaaattctcactcctttcctcacctggcaataccattcactgcccagagcccaccgcaggcaggcggcgtctcttccacgtagtctgccctgcatcttccttccagaggggctgctcctcttgctggcctcccacagcagccctgcctgaactgcacagcctcttaaggaggctggacttgcaccccaatcctgttcttcattgtcagccatattggattaggatctgatcttgtccagctaggtctggtccacttttcagaacatctcccccaggcagtccgaactagctcgtcattcattggcttttgtagagcagaccaaaggtcccagaagccatagggtctcaaaggctaggaattgtccagttccatctgatatccagaagggaaatacagcccatggggcgtggaactgggaagattccacagaggactggtgtctatgagagggacccacagcaaccttgctaacaagtaatacctaacagttattcagcctttccagacaccaggtgctgtgctaagtattttacatgtgttcagccatttaatcctcacaataactcacctcttagatgagaaaactgaggcccaaacaggtgaaactcccagccagtaagtagcagagccaggcttcagatgcagttaatctggtttcaaagtccatgctctatcttagcaacatccacgctctatcgtagcaactacaccattgtgactaaatatgaaatataactgtacccagaaccagctgccctgatggcaacacatgagttgggctctctctaatctgtgaccatataaaaattattcatcaaaggtgaaacctaaaattaagacatggatcaatatactgtgagttaatcactgattcttttactcatgattttctctctagtagggaatcatgtcctagtctaggctccttgagtgaccagggttcggtacctcctcaaagccacccgtggatcaataacagctcttgtttaaatacagatagatagcataatctcttcctcattaatcatggattctgtgtttataaattcacctgcttgctaaaatgtccttataacccccaaatcaatactggtggcactttcatggtcacacacaggcaggtacagagcaggggaagctggatttgcatgatgggcatgttccatctgagatccggcgaggcaacctctctcttcttgtttcatctctgatgtttacaagtgtcctcttcgcggtctatttagtgccgtgtgttctgcatttttgtgctttttgtagtgatgtcactgtttagagcgaacccaagagtagcgctgctgtctggcgttcctgagctaaacaggctgtgctgtgccttacggggaaggtgcctgtgtgagacaagcttggatgaggcaggagctgcagtgctgctggccgtgcatttggtgttgaaaaatccacataatagcacattcagaaaaaggagaaggaaattggccgattcatacatgaggctgtgatagaaagggctaaagtaacacctattgtgtgggatggagccgtggaagtctctttcaacagaaacccacacataaaagaaggttgatgaaaatgttgtggccagaggtttgcaaaaacctaacccagtatttcccccttgagtgatgaccctgtattctctaattcagtactcacgggggctttatcagaagcaactgccaggactaccgaaaatcaattgtggacacacagaggaaaatgcatgcacttcaaattgaaatatatagacatgtaattttacatagataatacatgtatttcaatatgagtgaagatttcttcctctcctcatcacctgagcagtgtcagcctctgcctgaagttctgcccctgagtcatggagacctacccccctaagttaggatcctgagcatgtgcagccatggcgcatggccatgccggtctatggtactggtctcaccctcagacaggcagagttggggacatgggtgtgactagggagggaatcacaggtgctgcactgctctctccccagagtcaaccccttctgggcactgtgattgatgggatgctgctgctgaaaacacctgaagagcttcaagctgaaaggaatttccacactgtcccctacatggtcggaattaacaagcaggagtttggctggttgattccaatggtgagaaggcacatgtctgttggagggactcaaccacccccatcagccctcctgtctctggtcccaggaatgcttccctctccgagctgcactctgagtcctgggcagctgttcccttcagcaggagttaacatttccacggaaatcttctccaggagggcacagttttcaccggggtatcagggccctgggattccctctccccagactctcttattgtcttcctattgaagaatcctgaagtgtctgtgctgggagggccagtagagaaaataactctgcagatgggaaaacggagggggcctagaagggggaaggagtggaggagtccggagaagcagtcgggggcttcctggcttcccacctcgggctgggtgtgcgtaattcccctgaaaatcactcatgctcttcatcacctcattgaaaatatccaaagaaagtggcttcttcttgagttaccattgacttctagggaacagcagacatcagcgtctactaagagagtggatggtcagaggaagatgaggatggaaaagctacctaatcgggtgctatgctcaatacctggtaacaaaataatctatacagcaaactccagagacccaaattacccatgatcaaacctgcacagttacccccaaacctaaaataaaagttggaaacaaataaatggaaaaagtaattgagttctaaaagtaaagaagtgttctccttccagttgaagataaacaaaactgaccctggttaaagcagtaggacagatttattcagtaatatgattgcaataggggaaatagtccagcgtggagtggactcacatccctgaaacaaaagcctgatgacgtttcataggccaggtgtgccaagggaaacactgtggtctatggggagaggcttggttcatgtgactagaccacctggatgtcttcatcctggctcacctggggcagaaacaaactcctcttatctttaggacaggaagccatgcattagaccgcaggaagaacccactgaagtcaggctctactctttcgacagggactgggaagatcaggagtgagctccctgaatgtttgcattgcaaagagaaggctctcaggtcctcaaggaaatggggttgggtggtagattcacatcccaaagggcagagaaagtgtttatcattgcaggcttctaaagtaactgctctagttgggttcggggacctggctgcttgtctccaggttttggctggagcagagtaaattgtcctggcagggttgagccttcccaggcagttatgttaaggatactggggtcattctagggacacagccttaagctgctagaagcaatgctagagattggtcgagtccctgagtgcagaggtttgggaagagttgttatgtgcgtagagatgtgcagttcgcccctcagaaggatttcagaggttataccaaagaccaaagccacgaagacaggatttaaggatttcagtgtcatctgtgacaggtgggggtactagggaggtctacatcctcttccccagagccctctattccacactggcctggcagacaccttgcatctccatgtcactgaccactgtagggatcccagccacagacacacacacacacacgcgcgcacacacacacactgcaaaacactgccacagcttctctgaaattttgttttttgttttttttttttgtaaactttgcaatgcttgagtttctggatataagcccatttgattcattgatttcacccatttcagtaaagactcatgcccttaaaagcccccataattagaggactttcagactgcattggtttggttggttggtcagtttgtttcttatcattaattcccaatgattcataaatgctgaacttttttttttttttagcagttgatgagctatccactctccgaagggcaactggaccagaagacagccatgtcactcctgtggaagtcctatccccttgttgtaagagtctaggaatcatgggaattggctgagacccagagagggacaaggacttgcccaaatcatagagcaattaaatggcagaatgaagactggggcctcagggtttcccccatctttccacctttcccacttcattttccaccctagcggggagttgcacagggcttatggggttcaccattgaggcaggactttctggtgggctggagaagctgcatcgctcacccggggctggtggtcactttttgatctatttcagtgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagaggtgagtcccagaggtcgaacgggagggacacaaaccccacgagcttctgtatctgacccacctacctcccagcatagacagacatggaaacagctgagggtcaggcctcaaaggctgattccatatggcatgggatgaggtgctgtcttattttggtttatgccagcagaagactgtgagaaaaaaaaatccagaggcaagtggtttttttaaggtgatgatcccagataacagcagtagggaggtggggaagtgagagaggaaagagatggaatccaatccaagatgcgttgtcaagggagtatccactgtggacaactggagcggggaaactcaaggaaacaccaagaatacagggctcaggggcatcccatctgagtggcaagggagccgggtatttattcaccagcttctacttgtcattggttgaaggctcttgcaaggaattgtttattccctgtgacttcgacctgctgcacacaagggcagagtagtctcttgtgaccagacaaaggcctcaggcctggagctgcagatgctggaggtggaagtcaggctggcatgcccaggaagaggggatataggtgagaccctggcagcatctgctgcaagggctccatgcctggagttattgtgggacatagggctgctgtaggacaaatattgaaagatgagtcgtggaagggttttaaggtctgagccagctgcaaacaagtttgttaagtattggagctggataaaaagtgggagccctgcatgggatccagaggattgtccaggaccaagaaggccagagagaggagccagggcgggtgtgggagaggtggtctgtagaatggcagtgtctgagggtggtttttatgcatctcagtgcgtgcagtagcatgcaagcacagggcaagggcagggtctatgcaggacctgctaccactgacccaaggctgtgtgggtggggcatgacgttagggatgtgtgtgctcacctagagaggagtgtctgttcctgcgtgccagctagaggagattcacaggattccttttcttccagctctcattcgcctagtctgcaagctaggaaatgtcctctctctaaccatgctggaagggtttttaaatttagaacttcataagcatgataaaaactagctaacgcttaactagcaggtgccctgacacacctttgcacaggaaggggcaggtgctcataaccctcatttcttcacagggtcctgataaaaacctttaaccaagaccactggagttgaatctgttctttcttaaacttgcccttgccctatgctctgcgtctgaactatatatagagttcccatctccattttctgatggtttgagcaatactgaacttatgtttttcatctggtttcccatgactttaagttcagggcttttttttttttttttttgccaggactacacagattttatctactttcacttattgttgtctcactctttttgataaaataacatttctgaatataaaattaatatgttaaattatagaaactttcaaaaatatggaaacacaaaaagaagaaactatgtatcactcatttccactacctggaggcaagtgctataaattttttgtgttttcgtctaaagattttccatgtcctatatactttaaaaatcaattttatattttacttttgttcatagaacactatgttgtgaggattttctcaatgttgatacaaactcatcaaagcattccttattccatgaaatggctgtgttaaatagactttaatattcatatcctattagatgtttagcctggctactcacattctgatgctacaataacattgagctcagcctaatgttcataagtctctaaacacatgtctaataattttcttaggattatttttagaagtaaataactaggttggacaatgcaaatgttttagaactttgggcaaatattgtaaaattgcattccactgcataagaatgtggatttcttaattctctttctcatttgggatgctaagattaaaaattagcataacacttccagtttcataagccttccccaccaacaagaagcacatcagcctgttttaatctgcatgtcctccatgactagccctctcattgtctctgcttctcttattatgtctaattgtcattacccaaatctgtgcgctactttcctctgaagacttgtgttgtgattgtaagaattgtataaatatcaatggctttagccaaagagttttacaaagtacgttttgggcagcatgctgcctataataagttctatcattcacaaaagctctttcttctatggttggctctgagtttctttggaaaatgttcgaggggcaaaggcaaggtcaaaccctccttttagcaagttttgtttgaccttgaagcagccatttaacaggtggattacagagccacagaaggatggcatcttcccaggtgcgcttcctgctgagccgagggtgcagtgcaggaggctgacaaagatgagtgaatagattattcttcattctcacattgaaatgacatgtgcgggtggggcatgaggttagggatgcgtgagctcccattgttaaatccttttgtgaacgaatttttaatgatgttaagaaatgatggctggaggcggtggctcttgccaacactctcagcattttgggaggctgaggtgggaggattatgagagcctaggatttcaagatcagcctgggcaacatagtgagaccctgtctctacaaaacaatttaaaagggaagtgattacagtgtactacaaaataccatatataatatcatccccagttaaatacataaaagagagatatgctaaaataaaaaagaagcattctctgagtggtagagttatgagtgatactttaaatttgattgttaaaattgatttttaaattatataggatatggaaaaattttagaaggaaatacaaaaaatgcatggcccttgcctcaggtagtggaattatgagtgatatctagttttgctttatgcgtttccatatttttgtttcttctaattattcctaattgtttttattttccaaatttcttactgtacccaaaggggaggacattgtaaattttctccaccagcctggcattgccctgactctttccgtcttagtgtcacttctcagtgggtatcatgaccagtgcaaagtgctgaggcacagggccaggcggcccacgaggtagccctgaaggggcagcgatctgtggctccaatgagccaatcattgggaaactggcatcttcctggggctgggacaggagagctttgttggtgggagaggagggcagagccgaaggagagagggcaggggagaggcaaggtcacccttgctcagcgccttcttttctctgccagggctttactgccttaacaccctaacactcccaggccaggcaggcagcaagacacatggggacagtgagctataaagcagtgagtgccgcaggttcctgagacacaagaggcagattgttccctctctgcatatgtttgtatttaaatagcctcatgttcagacaagcaacttggatttgcttcagtcttctcaggatgggtgagaaaaacactggaaatgctcaaaacgaggcagaacagaagacacctgtcatggtggagatggcatccaagtgaatgaacgcgagtctgttatcaatgaattatatccggtgtaaccagatgtagagagattgtcttgtgtgagaatgcaccagcaggcaaaggggtttacgaggcagagtcagggtccctgcaccggcagctgttttaaatgaattgacccagggtttccacattcattcattaaacatttgttcattgaacaaatatttggctctaattccgcttccacctcagacagctatgcagcccggagcgcatcactgagctttcctgagactctgtttctctactgtgctgacagccagaggtttgctgcagagctgaagaccttggtagcctccaggtgtgtgtctggcaacatgaactgtgcatgaatccttgtcttctcagatgctggagcacccacctacatgtatgagtttcagtaccgtccaagcttctcatcagacatgaaacccaagacggtgataggagaccacggggatgagctcttctccgtctttggggccccatttttaaaaggtaatgctccttcctgtctgtgagctaggagttagagacttgggttccagtcttggtgtggtggccttcagcaattttgtcctctcctggtcttagtttcctgattctgtataacagggttgaatgtcactgggttgtccgccggcttcctcccactctaacacatgtgaggagggatgtgtattcatgtgccctctgcacagacgctcagaatcctgctgtgtgacatcaagacaggtggtggtgggggtctcctgcaggattcactatgacagggttgaatgtcactgggttgttccccggcttcctcccgctctaacacacctgagggaggatgtgtatcatgtaccctctgccacagacactcagaatcctgggctgtgtcatcaacaagataggcggtgggacacatgcggggccctgctctaggttgagaagccaccaatcaatttccctctcccaggagcgctgagacagtgagtgagggtgagattagaattggtgttaaccctaagtcaggtctaatgtgtgcctgtttgtctttctgtctgtctctaacaaaaactcataaacctttacatttagtacatttaataattgttgatttagaattcacaggatgtatgaatttggaacaggagaagagaatattttttatatggtttatagtcagcaaggtggccatcccacaggctgggaaggtgcctctggccaagcccagaaacgggctcattggaggaggggttgggtaggagctttatgtgaacggattggctaaacatacatgttcaacaggttacagggggagcaatggatattcatgaagacagtcctgacacatgtgtattaaacaaacacgtatgtaacatggcccatgttcacctggtggtggagacctaatatttaaatgtattacaattagggcctgtaagtccaaaggtcttctcaggacacgaagctcagcaagtgaggagcttctgtacaccggccaggtccagtccatggctggtgatgttcttatctggagaaagttactgaaatcagtctcttatgcaatcaaagcagtagttaagtctggcaagtcagggttctgtttgtctgcgtatcccagctgcagccgttgttattgttttccttttgcttagctccaggccagtgctggtttagctgctagagaaagagaagcacctcgtggcagtgagaacaaagtggattcttttttttttttattattatactttaagttttagggtacatgtgcacattgtgcaggttagttacatatgtatacatgtgccgtgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccacggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttagagatgcaggcctgaacccttgcccgacgtggccttaggtctcgtttttaatttggtgtcttattgccacaaagagtgtgttctgtcagaatgatgaccttcattttattgctgatgctggtccggtggtgtctaaatcacaaaagggagggagtattatgaggcgtgtctgacctcctgtccgttcccaggcaggaacagagttgaaggtttttcgaggctccccttagcccagagagggtctgttcagtcagttgggggtgtcaggattttatttttagtttacattatacaatagtttaaaaaatcctttcacggtgtcttctaagtcttaactctcagcagttacagatcagatgggactcaccccatggctgctcagaacgcaccagcgcctctgggcatctcactgtgcatgcttaggcgccttgcggctctgttgtttttcagaatgtgaattgtgggtgtgtgctggggagggagaaaagacccaagagagagcaaccctggaaagtggggttgctgtagaggaaaccctggggtggggcatttcctgtgaccctgagcggggaggaggcaggcgagggtcacaggagacaaaggcagccagccaatggaatgacgcatgcccattgctgagccctaggtcagatatgctgaaaggtaaagtacacacaaatccaccacgatcttctaaaagtgcagacctcagctcagtgggtgtggggcatgtgccaagactatgtttccagcagactcgcatgtgatgttgacgctgcagtccacggaccacactttgagtaacaaaggctttttttcttcttccccacagagggtgcctcagaagaggagatcagacttagcaagatggtgatgaaattctgggccaactttgctcgcaatgggtgaggctggtggcaaagacagagcacggctggtgagggtggggggcggggcatgcctattgggaaggggcagcttctaaggttctagtgatcaaacttctgaccctgtgaccatagcactctgataatgagagctctctgcaaacggagaggccgcccctggagatagtgagctctccatctctggaggtatacaagcctcttgacagagataacttgggcatcctcacacatctctgaagattgttgggaacacacagcagctttggggcaattctaattgattctgtttccagaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggcc

SEQ ID NO: 37281 - DNA, 33746 bp, Homo sapiens
gccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccagggtaggtgtcggcattcttgcttttgctgcgaggtggggactccggcggcgtccggggggacgcagtggatgccccggggccgagggcggccagaaagcgcgcgagggcgggcggacggggcgctgctggctcccgggcttcggcgcccagctccgggggcggcggcaactccgtcaagtggctgcggagcggctcagagatttgacaaagtccgctctaaaggtgtcccatcctctgggtccgcagcgactttccgaggagagccactgggctcagggaaggcgaggctgccaggctcgagtgcctcctcccctttaggttttaaatgttttatatgtgataacagaaataaaacacaccccatcgcccttccgtaacaaatgatgggtcccgggtgggagaggcgagggactggcaccccccggcattccctggagctggcgcgcatctgagcgtttttctcgtccggatgaaaagttcagcagcgcgctgttcgcggggcacgacctgcgttggccaaactggagccgctcctatcagcccagacaggggaagtcttcctaatgctcactcctcagtttccaggcattttgagcacgttttccaaagctgagaacttggcttaggaattaccaacttctaactctagctacaaagaaaacgtggcagacagtttagtttacctgatgcaaagtaaaccactcagcctaaaacggaaaataatgctttaatgtcaaagtcaagctttacttggtgttctctactgtctaatgagaaaacaaggtaaaaataaaacctcagggtttctctcctgtcagtaaatttgtagaattaattctaaagcattatttggtctagctggtttttttctaacacaatgtttttcttcatagaaaattaatgtattatttcagttatcacatataaaacatttaatacctaaaggcgtaaacttccagaatattatacttttagttgcagagtattatactttattttcttgtattcttctcatgccatattttataattgtatgtgttataatctgattgatctgctcatacagattttgaacaaggtaataccttttaaattctgttttatttatatatgcctatgagatttgggaaccaacatccttttaaaaatatgtcaaaatgtgtatcctacagacgcatacaatggaacgtttcaagccttgttttacatttttcaaaaacatataaacacatctgacgtgtttttatatgaaacatgaaaactgttcaacatacccccaaaaacgttcctaagtaaagtaagcagaaaatgcttcagtgacctgggccaagcaattcctattatagatttaccaacaaaaacagtttccgttatatctactaagaaatgttttagtttctggagtatggtttttatttaaattgaataagcttttgaatcctaacacagaataaatcatatttatattaaattctaaccaaaataattttgtcacgaaaacttttaaggtgtttataaaagaaatattttgctattatagtataatcgtatgtcaatataattaatcatatgcttgaaattttgagttgttgacattataaatgtttattttaaagcagtacttacattccagagttggactacaatagctattggtaaatatatttgatataatggcagttattattagggaaaccaattctatctggaattcctaactcataactaatttgtatcactcatttttgacatttggttcaataacagtttatgaccaaatatgatttcacttgattatggcttttctctttaattaattctaggacagcaggtaaaaccaaatcatttttgtatcccaagtgtccccaaagccaggtatatagtagattcttattgaataaataagaacatttatttattcaataagaacttttatgctttagtgaacacctaattcagaatattttcactgaaatgataagaatattgaaatttgttaaggaaaagaataaaaagtattacagaaaagtattacagaaaaataactatcagtattgttaaatggtgaattgttgtactgcttttaacattttaacaccattttgaaaggcagtgtgtgaggttgtaagtgtgttattgtactctcttgcttgccaggcattgatgggaaccttttatgtgcacgaactcactgaaatctcacaataatctttaggagagtagcagtagtgacatccccttttgcaaatgaggagaatgaggcttcaaaagatttattaacccgccgatgatcacaagcagtgggacaggctctgacgctaggtctgtgtgcctccaaagcctgcattctgaaggccacatgtgaaaatggacacctgttccaatatttctaaagagttgttttgtgccatcctgttcatcactggccttattgatgctgtcttcaacatctgccactttccattttttctactactgtccctcttcaagatttcctagctccacgcctagacatttggctcccccgtccaattcacacagcatattcttaccgtctctggaaaatgccaaattgctcctttctcattcttaaaaatccttcagcggcatcacttgtttgtagagagtgaaatgcgtgtctttgcacaacattcatgacttttcaccatctcctatcccaatttgagttgctaacttcatttctttcctctccctttgttgtctctccctttcctccccttgttccacacgtaggcagtggtaccgccctctggactacttacgatttccctgacgtgtctttgctcctgataccatttttccccacaccacaccactgtcctctgtgcctgtggaaaccactcaaatgcctctccccaagccttctttcagtaacaaccatctcatccggttgattactgtagctttcggcctgtataacccctccttatgtcatgcctgtaccagatgttccactgcatctgtatcccaccagattgcacattccccgaaggcagaaaccttctaatctgggggccattcagggcctagcacagtgcctagtagagcatatgtgttgtagaataaatatagacacggtatgaatgattgactagattgttccctttttacatgactttattataaataggtatagaatgtgttctcaaaaatatttcacaaaaagataagtgagaattgttttattgtgagttgatttgtcatgtttttgttttgttttgttgagacagagtctcgctctgtctcccaggctggagtgcagtggcgcgatctcgcctcactgcaacctctgcctcctgggttcaagcgattctcctgcctcagccttccaagtagctgggactacaagcacccgccaccatacccagctaattttttttttttttttttttttagtagagatagggtttcaccatgttggccaggctactctcaaactcctgacctcaggcgatccgcccacctcagcttcccaaagtgattacagtcgtgagccaccacgcctggctgatgtgtcagttttaaataagttcttaatatacaaagaattgaaataccaatatctacacttaaagccacaaaaagtcccataaacgagatgtgtttaatcgagtccccattaaatcagcttttgtcctcctacaagctatacccttcactccccgcctcacactatacaaatacagacgacagcaatactgctagacaatggggctccaaccagagtttgtaggagagtgacaaatatgactgcctccatcaattgaaattacagttcacaaaattaggacacagggccctcatgcccgtaattgtttacaatccaaatagccagatgaatctttgtattataaaaaaatcaaaagtaaggtaaatcaaacaccagacattctcaaaacaaatttttagcaactggttgtgataaacacaatttttaggaaagcagtttctaggcaataagtgtgatagaccttgtgcaatataaaatttcagttttggatgttcagtttaggggagggagttgttaaacaccgtgtataactggcctaagcatttcacagaagaatttgaaggttcacttcttcaagtgagcatcttttctttttataagaagcttctaaagagtctaagtttttggaccatccagaagctagatctactctcacagacaagttgcaaatcgtttgctttgacaagatttcaatatggaatatagtaatcccctctcatccacaggggacacattccaagacccccaatggttgcctaaaacctacattagtaccaaaccctatatatatatacgtgtgtgtgtgtgtgtgtgtgtgtgtatgtgtgtgtgtgtgtgtgtgtttctatgcatgcatacctatgataaagtttaatttataacttgggcacagcgctcttgcactttggggccattattaagtgaaataagggttgcttgaacccaagcactgcaatactgtgacagccgatctgataactaagacttcgaagtgatttacaggtgaagagtgcagcatagacaaggtggatacgctggacaaagggatgatccatgacccaggtgggacagagtaagacttcatcgcgctactcagcacagctgcaatttaacacttatgagttgtttacttctcaaatattccaattactatttgtaggctgcagttggtctcggataactgaaactgcagaaaataaaaccgtgaataaggggaggctagtgtacagggcaagcttcttttgtgtacatgatataaaatgattgtctatatctgatgccagtgtgtcttttctcactaaaatgtcttccccctcttcactcctccctccttcctatgcagagcacatccaagatcaagattattataactgagaatgctatatgagcttgagtaccaatatagaaaaagttagtgtgttcctaatttgtacaggctttaagatagaacagtgtatgactttaacataaactacttttgaaatttcatgtaatataaactacatttgaagtttaaacttttagaaaggactgtttgcaatggaatgcaattcttttccagggtaaaacacaaatgtagtggaaaggttgatgtaaataaaaacctgttcaattttgttctaacacagaccgtgtctacgtggaagtactggttcatgtgtaactcatacatcccacaagcatctactgtgtgcagaatgtctcgtatgtgaaagacactgtgggcatataactgtggcttagatgggcttctaacccctgagaagataatatatcagcagaaaaaaaggaacatgtatatgaactgccatcacacaacctatccagaattccacaagaaaagtatggtcaaagagctaggaggtgttgaaggaaagattacctgcaggagaggcaatgcgagatgatagaagattctgagctatagagcgaggcggacccagatgggaatttcaggttttctcgggatgtgggaccctaaccaagcttcttatactttccaagcatccattttctcattttaaaaaagagataactatgttgtaagattgtcttaagaattatgtgagataatagttctcaatagtaatacggtgatggttcccagccctggcagcatgttaaagccgcccatgtgacttctgaacacagccatgcccaggtgcatgcagagattctaatataaccggtgtggggtgtggctctagaaatgtctttggcaggcaggtgctgcagggctgtggatgccaaggaggcacgcggagtctatttgctagggatggagaatgaacaatggggtttctcatgattttggtccgtgcctaccgtgcagtgcttcagtgtgtgcttgtcttgctccataactatttcagtcgtttttattaacagaaacatcatctcaggaccatgtcttgggcttgccttacgtctccacataaataggacattatagatgctttatctgtgttttcagttagcttttttttccccaacagatccaagtaatataagttgatgtgaataacagaaatcatctgaggcgcttgttgaaagcataaattccctggctcctctcctagagattctgttcctgattccgagcatctggaataggactggagcctttaacgttcagcaagggccccaggtgattcttataatcacacaagtttgaaaacatggtgctaagtgattcactgcagtaccgtgttcaatgatctctctggtacttttgatatttgagaccctaatgaacctaaataaaaaataatccgctgacaaacactatgcctcatttcagctctctcttctaatttgggaaaacagtaataaactgtgcatgctaatacaaagtaatataataaggaaagaatataataatgcaataaagtaataatataaagtaatgcagggaaaacagatcgtttaacttagtaaaatcaggccaatttcgcagtcattttctgatcactgggctcgctgaacttgaaaacgaggaaaaagtaaagacatcatgttttctccttctctctcattcctctctctatttcctttttctcatcaactgtctccttagaggtctcaggacagcaataaccaggttgaatacaaaatgagaagtgggatctggccatcactatcaaccacctgtcctagctgacttctgaaggagctggtgacatagctgtacagctgctcagcagcaaagccgcaggttacttagacacctcttctcctctgaaagccagagccagttttccttgtccagcctgtcttagagagttgtaatggtcaaacgtgtgagaaggagctttgcaaatgtaacattttgcataagtataagatggtattatttagtattaatattgttagtaaattttagtaatattcagtatctaagatattcaacttagatatccaatagttattcattatctaagtccaatatcaggggtatggctctagatatcaatagatattggacttagataatgaaaagctattgttcagatgtgtgtttaaaattagtgtggacacatgcagaaacaaacccccactcatcccaccttacactcatcctaaccagagctaaaagaaaagttagacttttccaaatcagaattgagtattacataacttaactctattaaggtatattagaaaagctaagttaggctctaaaagcaaatatgttgagatacacctgcttgtgtgttttgtttgtttgtttgtttgttttgttttgtttttggtgagaggaggaggtctacctctgttgcccaggctggcgtgcagtggtgcaatcatagctctctgtggcctcaaactcctgggctcaagcagtcctcctccctcagcctcctgagcagctgggactacaggtgtgcaccattatgcctagctttttaaaaatatatttttttgtagagacagggtcctgctattttgcccaggctggtctcaaactcctagcctcaagcaatccttccacctcagcctcccaaagcactgggattacaggcatgaggcatcatgcctggccctgtgttttaactcaaagaaaattattctagtcttagacatttaaaaatagaaaatactgattttgacaaatgagagaaaattaaaagtttaagattatttttatccttacaagtcactttggggatggaaacttttgttctactaacagttctgggtctgagaatgtttctaaatggaaaacggctatgaaatgcctcccaaaggctaagatataataatccccagttgtcttcacccagcttctattaactgttcctactgggaaatcattgtgatagctacagtgaggtgatcatagaaataaagtgagtacaataaacattttagtaatgagacagaagatccaggacacaagacaacttattattttagcaatttttatttattcagatgaacttgtatcttccttagaaccgcaattagatagctagaataagcaaataaagaaaaagcaaatgaattactgatccctaaataaagcattagaaataatctagtttcttcctggagcagtttgagatttgatagtagtatgtattgttctgctctaatagaaactcacaaacatagcaatgacaagttgacattaaaagccataatctttgggtatatagggactagttcttttttatataagctctgacaaatgctttttaattgattcttcaattattctaaatactggggtatacactgtgaagtattaaaaatatacatcatattgtacatatcctcaagagcatccagtctagttgggaagacagacaatacacgagtaaataaacaaacataaaagtacaaataactttcattaaggaaataggatgtaatggtgaaaaatgatgaggggaggactagagaagctacttcagatgtttggcgaagtctttctgagagtgcagcatttgaacctagacctaaaggttgagaaggagtgaagagtaagggaagcatttcaggcagaaataagagtgcatgagaacccccagaaagggcacaagcttggcctacatgaggaactaaaaggaaatcagaatggccacagcaccatggatgagggagagcaggaataatgtaagatgatatgagagaagtaggcaaggtaagacccatgtgaggtctagacagaggtgtatagttgggatttgcccagaaaaattgggagtaggtatactggtcaaaagaatcattgactttaactgaatattcaacagtaataattacaaacttcctatttttaaatattttaaattatgggaaaccatatttttcccatattctgtattcttaagtatttcttttattcctgcccctgaaaaacatgtggacagcataaaattggatctcacttcttcacctagtttgatagtctctgttttttaagtgatgtgtttagatgatttacatttaatgtaattgctgctatggtttaattaaaatctactgtcttgctagtttggtttcatctgtccttcattcgtggagaagagaccatgagtgaatacaaacttcctttgtctctggtttccgggagttctgtacgctcatgttaactcacactggatctttagcaatttgttaataattttagctgaattcttcataacagctagtatgggagccccatcttcctccatgccctgctccatgcaggtgagcctgtgctcatgtcttgcctttgcttgaaggcacctgtctttccttagatttcaagtttattgccctgtgactttagctctctgaagggttcaagagaagttataattttgtgtattatctggcctcttcttgttagtctctacagatttctaaacaaagtgcaatagactgggtggcttataagtaacataaatttatttctcactgttctggagaccggaaatccaaggttaggataccagcatggttgggttctggtgaggaaactcttctgggttgcagacacctcacttgttattgtttcctccttattggaggcaagagagctgagagctctctctgaggcctttttcataagggcactaatcccattcatgagggctcctcacttctgacctaattaccccccaaaagtccctcctccaaataccatcacattgtggttaggatttcaacatttgagttttggggggagataaaaagtccattgcatgcctcttacgtgaattttaaagatgataaatagtaaggattgctatatttggattgaaagcagtttcaacctgaatgtaaaagatgcctaaatatagtaaaactctattcccaaatagagacttctgggtgatgaaaaataaaaaataattttttaaaacaaaaaaatgtatgattcacactgggaattatgtaagatgttttaaaagagagtaacagatacaaggatatgaaatgtggttagtaagaaacaaaatcattcagcaggatgagaaaatagacctaactcaactgaccaactaagagttatctttagttagatttacagtctttctgcccaattaaacatttaaaatgttaccaggctgaaacacaaatgtcaggcacaaaactcaagatactgcgggatgttggtttttaaatagtgccatgatttcttccagattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggtgcttcttaactaatggtgcttaaatctgatctgttttgcaggagaacctgaaccagaactataaataacttcatcctcccagcaaggagggccacagacctagtattttggctgactttttatatattagctacttaattctttactaaagtcagtcaatctagcagttgttgacaaatcatttctaaaaaggattctctggaatgttagaataataaaagaggctaaaagaatttgttccagtaataacccggttaattaactatgaaaatagaactattagccacataaacactgaacaacacaactagttatatcactgttctcagtgtggtagagaatggaatggaatggaatggaatggagagattcccctgaaataatctcttgacttgcctgactgtaattatattaaaactggttgctaatatcctgtctgccattggctgttttgtacagaattcagcccagaagaatgttacaggtgtgagagtgcatatgcacgtgggcatgtgaaatactgagatgtttctgaccccaccccccaaaaacactaagaaattgagcctgatctcttgccatcagatccctgatccaaaactgaaccatgataataataatttgttatagtggttgttagtgtgtgtttatcctgttatgattgtactcacagttttccgtgctgtggtacagaaggatcaatcaatccaccaatctgccgtttccttggggtgaaatagattctttcactctctatgcataacctgtgttcatgccgagcacacagtcccttaggagccactaggtcccaggcagatgcatgagaagggttggacaaagcacatttccttgatgccagtaacacatccacctggcagatcactcactgtcttctgcagtggcctcagtaggactggagggaagtagggaggtctagggagcttgcctggtggtcatctgcagagtgtgcctgcagagtctccctctcctgtttcccacatgccttgcaggcctccttcctccagaaactgtgcagtgtactccaggcaatttttatctagtctgccatacccaaaaggacattaaaaatgtacgacttcggccgggtgtggtggctcccgcctgtaatcctagcgctttgggaggccgaactgggcggatcacttgaggtccagagttcatgaccagcctggccaactggtgaaaccccgtctctactaaaaatacaaaaattagccaggcatggtggtgggcacctgtaatcccagctactcgggaagctgagggaggagaatcgcttggacccagaaggaggaggttgcagtgagtcaagattttgccactgcactccagcctggttgacagagggagacaacattaaaagaaaaaaaaagggggggggaagactaattatgtgggaaaatacagaataatcagcaaaaaaaaaaattgtttttgcataagttagtgaggtttgctagtattttcacaaacataatgggaaactaaagtatgctaaaactgaaagtaccattagaatttgaagtttacaaattttattttatttccaggggagaaactcacttatggtctccacaagtatctgaagatgggaaagcccatcctttcaaaatcaacttagaatcagaaccacaggtatgcgttttagagcaaatgatacacattgtatttccttttaaatcatggggatgccttccaaggggaggaagagacaaatagaaaaattggaacaagccacctatgaagctgttgtctgtcattcctctccgagattaatttatattatccgtgttttcttacatcaagaaaaagaagtgttcctatgtgaacatcttgttgaaagacaaaatatgctcccatcagaaagaatttggctaaatctacagagtccacttattattttttcatttcttataatggacttctgtgaaatgaccgtgaggtaatctaaggagtttaagttgttaaaacaaagcaaagcaaaaataaggtctaccatttgaaacaggtgtctccaatctacggttactgtgaatttcagtccttcgaggtcttcacccagatctcattctacattcttctttaattctcatttctgggattctgtaattaaatttactctaagaaaagagtgttgcctagtgtgatgatggtgatattctgccgttacagctgaattataaaagataaaggattttctctggaggcaactgtaataaactaaactaatcatctgatgcttatctatgtctactttcaaaaggcccaaaaaacctgaaattaaatcaaatcttgattgtgatgtactcataaatctaattaagaaaagcattttatgacctctacatagaagctctaaaggtttagagatacagatacatgaatttaccatcccttttgaaacacatgttcctgctaaactgattagatattcccagcatgtagttgttctatataactgatgaaagggaactgaaaacgtatttgtaatttatgtttagcagtatttcccctttcaagaaaatcaactcctgaatttgtccttcaagttttctacttgtctccataagcctctgatttcttttgtgaaaagatgttgaataacatcagtacatgtgtctcctagggcttctcaaaaattagaataaaataatacaagcagagaagttggcacattgagttattcatagaaatactcaagtaagtggtagctgtccttattatcagtacgttacccccaccccaggctgggatccgaaagtctcctggcgtttcttgctggtgagatagttagctgcctacatgataggacatcctagaggctaggaatgccttcttcattgctattacgagggtcgtgacaaatggaacaaagctttattttcagttaaaatataatctctcctggagaagaaggatcctgagtaatgtaatctttagaggaaatgagtttattagattgttgtcgtagagttttgactaaagggaaggtagagtctgaatctaaaatccactaaaagcaaaagtaggagaaaataagccccaaaaggagtgagcaggacagagaatatgttcatgaaggcaggaaccttgaggctgttgtcttccctctgagtccctccagctcaataaatagcccacagctcaataaatagctgacaaatggatgaaaggaactggagggcctaaaaatgagctgtgcattttctaacattgccaggacctgtcctgggagccagttctcaaaatggtgttctgccatcactctcagctgttgcatggaaagtaatcttgaaagttgagtggggccaggcgcattgactcacacctataatcctttgggaggcagaggcaaaaagattgcttgagccctggagtttgagaccagcctgggcaacatggtgagaccccatttctataaattttaaaaattaaccagggcatgttggtacacacctgtaagtcccagctacacagaaggctgaggtgggaggagtgcttgagcccaggatgtcgaggctgcagtgagctgtgattgcaccactgcactccagcttgggtgacagagcaagaccctgtctcaaaaaaaaaaaaaaagaaaagaaaagaaagttgagtgggatacttaggctaggtaagacttttgctctttggggtaagtgagcaaaagaaaatggatggcacagataataaatataatgagaagggatctgaatgctgatggcgactccccctgacatactaggtgggctggtgaataatgacacctctagtcaacattttctttgctagaagaaaatagtggaagaaaaaaggaaagttcttgaggtagagttctcacttgtatctagccttttgcagagatgcccaggctgacctgcttcctcccaccgtcatcaatttatcacctggaggtgacacatgagaaaaagagactatatggtgcttttaagaattaaagtcaatagacatgcacttattgaccactcagcctcttatcattacctggaccaaccagaagggactctgcatttccttttccctacacagcacacatccaatattgcactgcatcctttgcaacttatttttccatgcaagaatttctcctaatttttaaacccaatttcgttaatatgagatgcaagaaatgaggccaactagatagatctgaccgaagtaccaaatccccagtgatccttcatcatggttgcatccgtcaccccagcatgtaagtaattcagcaagtatttactaagcacaaagtgagtttagaccaggatgggagcccacgttttgctaacatctctccagaattggagtttaagggtaattttccaagttgtagctctagcagaggcttctattgcaagtctatgagtattaatttatgactatggttattctaaggatgggattttaaggcataatcctaattttaaatactctgacctcttgtcaagcatgtattagcccttgtgtcctacatttgggggttagaaaatatgaatatttacaatactacaaatgagaaaaaggagattaaattgttttttttttaaaggttgagattaggttaagggctatagcagccagtcagatggagccttgaaacattccatgactttgcgtcatgactaattcttactgacatcctctccaagaggccggtgtttgaaatgctccaagataagaacaattcagttctactaatgaaccaaaggatttctactccttatgagactcttaggccagatttctgcacggccagtttatgtaacttggtacttcaggacagacattccctacacaaaaataactaaattgcagtgtatctcctgctatccaaaaatcctttagcgtaaaccagaacaaaacgtgctgataaaagtcaaacagtgagtttcacttgtggactgagacgagagaaaagctaagctatggttatagggttttttgtttttctaagtaatacaaagctgtgcaaaaaagatgtctttttcttttttatcaaaatgacaactctgcaaatacagcaatcttctggacagcaaatacgtgtcagttagagaaacaaatgccattaatattatcatgcttcaggatgtcattgcagatgaatagcaaaaggccatggaacaatatgaaatttgagtttttgtttctcaacccaagtcaaacttttattgtaagttatgtgacctttgacattggaataaaatacactttctcacttacttattggggaaaaaactataccatccaagcccagccacagatattaaatattagtatgtttatttctgggggtttttttcccctgtgaataggtttaagctaaggagacattttcttatatggttataggaatagttgatataaaattttaatatctagatttttaaaatgtggccgggcatggtggctcacgcctgtagtcccagcactttgggaggccgaggcaggtggatcacctgaggtcaggagtttgagaccagcctggtcaacatggtgaaaccctgtctctactagaaatacaaaaaattagccagatgtggtggcacacgcctgtggtcccagctactggggaggctgaggcaggagaatcacttgaacccaagaggtggaggttgcagtgagccaagatcgcaccactgcactccagcctgggcaacagagtaagactccgtctcacaaataataataataataatttttccatgctatcatcaaatagctaagttttgtttctctgagtttagacttgaatcttaggcttaaagggcacgttagttgttgtttagatcaactcccagcacctgaataaatgccttccatgcaatcctgaacacaatctatttttctctatttttctgtacaaaaatagacaaaatggtccattttttagtacgaagtgttgctcttgactaagagtatgttaatgaagctctttgtcctttttcaaagcttacattctcaaaccataaccctcatatttgcttaatgttagtggaacaactcaaaggtatactgtgcctgtcacaatacaagaaagatgctttcagaaacaaaaatggttcttatctaaataagaagaaagctgtctccatttccataaaaaggattgcatccttgccagagaagataatagagtttacatacacagtcaagaagagtgtgggataaagtcatttttattttcacaaataaaaagtgttttggtaactggaaggcagcccatataaaacaagctttcatagtcaccatttcctcaagctcttcccagtgagagatgggaaacacttgaaactgctcactggagaaaaaaggatgatgagggtgactttactgtttatttgaggggtgagtatgaggaggaagtgattctaaacttcaaacgtgatgaaatataatttcttcatcatgccttgatcaaatataagatcacttcatagagtttgtttctcttatatgcccaccattttttcatatatatatgatttgattttatatacacatatgtatacatattatatataaatatatatgtgtatacatatatgtgtgtatatctatgaatcaaacatactgtttctgttggagatggttcagaattataaagattatctgaatctttatctgtgagcagtctccaagtaagaagttgaaaggtgaagcctttgactgctgtcatgtctgaggtcattccaaggacatgggagactgctgtccatggttggatcctcttaacatcagcagagttctgtcaagttacttagctttcactggggcagctctagcattccattaattcaaaatgttgttccttaatataagcctctaacatttaaaataaaaattttaaatgtatccattaagggaataattacatattgaattcctaagaaataagaattatttgggtggttttttctagatagaataaacacaagagctggactatattaactgttgtatacacttttttaactggcattttcagttacttgtgatttttccaggaaaaataaaaatgaattaaagtggaacagcggacttctaattggttttgtcttttgattacatttgaccatcaacaatgatgtaagccttggatagaatgttgcccctcagtgccccacttaaatttcttggtaaacctttggtgtatacacttcattgtgctttttggaatgactctaaaagcccataaactaatgctttgcaaagcctaaataaaaatgtttgcagcctgtattagaaacacttccttttatgatctgaatgtaaaatagaggttgttggtttttttttttaacaaattacacatttgtgatctttgcaatatatgtgtaaccaaaaccgaaaattgcaaagaaattgcttggagctgattaacttacatgctgctatttagaaattctactagagattattaatgcacaaatattttcagagaagttgccttatttacaggacaacactacctatatttaattatcatcttaaggctaagaagaaataagggcagaggtattttccataaagccattatattatgttagtttttattaattcaattctatttacaaagactttaaggcaggccttactttctttaaaaaaaaaaaaaaaaaaaaaaaaaaaaagctaagctccacaaaacttaagtgattcagtactgcctgattctttaattagcctgagagacttgtaatccaccaaaacttaactaggcagttaggcaattagtgtgctgtcttctctcatatcaaaaaggcttgaatcatggccattgtcattacttacaattatttctagtttttcatgccataataatggctaattatactggttaatcacaaaactcagccaatccaaattcactaataaatcagctaaaacaattagattgcaccatttataaatgtttagctacacacattttcacaggatctaggattaggcatttttctaaagctacatttgatggtttgggtcattctacctaagagcagctacaataatgttaatcaactccttggctgtgagccattattatgaaggaaaaaagttaagtgaacaaggtatcagcgaactcaatcacactacaaaatcatagactaaatggaattcaactcagaccttctttttgggttcaggaggctgttaacatatgctgtccaaggttggtgagagaaatgctgttctttaccccatcacagattctcagatcccctgagatttggggtgggtggagtcaaaggctcctaggctaggatttgaagctgtaccccattgccctggcataatttttgtttttttaagtgagctttgccaataggcctagatagtagaagaaggagtatactcagaagaactgaaagaaagcgttttgtagctggggtccctacaggaagttgttcatattctcaggcacaagaatcttctatgaaaaactctggtcttacacctagggaagagagacactctcttttctttcctcctcctttttcttctttttgtttttgacagtctgttttctaacagaaaagcataacccacaacttatctgaaatgaaaaggagaaaactaaatattacaggatcttttaatgttttaaagacgataatctctttccagtattatttcaaataattatatatgtttgtacgatttcaaatctggaacactggtgccacattcacgaaagtaaatgaagttgatgtgaatgtgtaagggaaaatactgttagaaagatttatcttactaattctgccaaatagaaagatttgggactgggcgcggtggctcatgcctataatcccagcactctgggaggccgaggcaagtggatcacctgaggtcaggagttcgagaccagcctggccaacgtggtgaaaccctgtctctactaaaaatacaaaaattatctgggtgtggtggcacacacctgtaatcccagctacttgggagactgaggcaggagaatcacctgaaccggggaggcggaggtttgagtgagccgagattgcgccattgcattctagcctgggcaacaagagtgaaactctgtctcataaataaataaatattaaaaaaaaagatttggaaagagaatcagctgacctgtaattgagcattcccttttggttttcttctgttgcttagaagaaaaaagttttaaaggctttacaaaattataaatctgtacaaaaactggaaaacatgattcccacgttaaaaaaaaaaattataggattttagatcattcagacatgtttcaaactcagggttgaggactctgctgtttggtccttttcccaaggaataaagtgaaaatcctcctgtgaaccatacacattttctctctctgaattactgactttaatcttttggggactagagtaaacatgaagaggtcttcaaacacacaacatgaaatcattacaataaagggaggggttgtatatgttattcccgctttcataaaaagagtctctcacttgtgttttctaaaattaagattatagcttaatccaagttaagaactttttgttaaaaggtgttttcaaaaacgagttttcacctggcttagtttaaatgattcagtgtagctaattattcgtaaatgctcattctccttgttttgttccctcatgtctcaaaatgggggaaagtttatcaatgtatcaatagaagagaaaccatatgtaaattctacttgagaaaacgttaagtatatttttcaagccaaaaatcccatttctgacacaaaatgtctgtattcaaatgagtcattagaatttcttaaagctatagatgaagaagtcaggggcagataagaggtgcaatgtttaaattattttataatatgttaaataaggtcagttccttttcaccttaacatttgatcggtgaatatagcacatgtaaagctcagagaaaaccatggaaaagtttatggctaactcctcctctaatctttccgtcaatctcgtcgtgggtaaagatgcctttattaacagtagtgatgctgttggtttcgctcactaatggctttcttgtgcgctgtgtggctgtgtattttgtctgccattgtacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagtaagtatccggctctgttctggccacagtgtacctaacagtgatagcatggtttcttttcttttcaaaagtccagctcttgctgttttatttttactttcctgaaggcactatcagatttctcttttaaagacaagcatctaaaacatgttctaattgttgtggggtccaatccgccagtgcctgaccgtttagcggatagatggttggaaagaagacatcgtcctggtcccgtcatcgcctttcttagttatgacagtagttggtggtaaatgatcctccctgtacaactatcgttcgtttaatcttatctgcaacagtgtccgccttccactgagggcctttttaacgctttgttttcacaggacgggaactactttgaacacaagcataatattcggcccaaacctttcgtgatcccgggccgaagcaggtcataagcgctgagactgtggagtttgcagtgcatgcttcttaaatcagttcttactaatcatcaagaaaagtaactggtagatgtttggagtggcttttctcattgcgaagcttatttcaaaagcaaaaagaaacaaactcacttggcagagaacagaagccaaataacttgcatttccaagagtaaatattgacaagatgacagagctgtgaaattgtatgcaatcaccacgtgtatttatagcgaacacccctgaggctctggggatcccatccagaacactgtgacctttgagtcgggcagtcagtatgtctatcccaggtcaggaaagccctgccagcaggagcgagcatggaaaccagccccggttaggaggaaggaatcaggtgaacaagccagaatgataaggagcaagctcttccttctcgtctctcagtagagaaactgatcatcttcagatcatccttttcaaatatcttctctagaaattgaactccaacctaaggggaaagaaaataatgccctgtattgccaaatcaggaaacagtgacttcaggaaacctctgttccatccttctgacctcagctaagccagtcagcccacaggaaggaagctggtggttagaccggattgattccgacaggaacattgaatatgatttaccgcagctgttgcaaactgatggcccataggtggatttatttcacaggcatgttttatttaattcttttgtttaaaaaaaaaaaaagaatttaagtgcctttagacagaacatttaaactcaccatcttgtcaaaatgcacatcactcttaagtgtgtgagacacggcccattttcatacatgtgtgacctcctggcccctctagacacccgagcttatgactcctgtcataagctgcggatagcaggtcatcccttatgtatgatttccatgtccagacctttcaggaagctacaggcagagccaggtgattgtctcaaaatatgccagacaattcttgtgatatcagatccagaaaggagccctggaccagaggagcaggagaaaggcgttaagaaggcaaccatgagcaaacacatcttcccccccctagaacgtgagctcagtgtctgcaggggcctggtctgactggctcaacattatacccccagcacctagaaatgagacagaataaatgctcaataagcgaccatctacaaacagacaaaataaatgcccaataaatgctcactggataaaggaatcaaatcctgagggtgcacaacatttcccaagcaagtggcaagaagagtccagagccgtctcgctcccgatgctggcagctctgtgtcctctcctgcttctctctatgtgttccctcgttcatactctgttctcatctgcatcttttccgtttctccactttcaacagcttccccaccccaacccaaccccaataacaaaacactggatttaaagttaaaaggatatgatattttactgttgaatatatacaacttcccaaagaagcatagtaaaattaatcacttgcattcttttcaggttagtgtgactgagtccacccacacaagctctggggcttcagaaggcttgaataaagtgatacgttagagtaacacatatcctgcctttactaaaaacctataacatttaattttataaaaagtcaggaaagtcagagaatcctaggtatataatcaccttttaaaaaaatttttcattttaacttaaacatagggataatggcaagccactcataatgttgtcatttgaagatcacaccttttaatgtagctgaatttggaagagagaaggagagaaacagaaatgagaaggtttgcttaaaaaacagatgccagtgcacaaatcttaaagaattataaggcctggtgcgatggctcacacctgtaatcccagcactttgggagacagaggtgggcgaatcacaaggtcaggagttcgagaccatcctggccaacatggtgtaaccccatgtctaccaaaaatacaaaaaattagctgggcatggtggcgggcacctgtaatcccagctactggggaggctgaggcaggagaatcgcctgagcctgggaggcggaggttgtagtgagctgagatcatgccactgcaacaagcgtgagactccatctcaaaaaaaaaaaaaaaaaaagaattataagagtgcccccaacatcctccttctcttcctgtccctcctcactatttgctataacttctgaattttttgttcccaccaaactattcttcatcaaggtggaattgtgagtggctgcataccagcctacaactagatttgtttttaacttttaaaacaaatgtagtttttttcgggtgcattctacttgtacatgtttatggggtacgtgtgctgttttgatatatgcatacaatatgtaatgatcaaatcagggtaattgggggtatccatcacctcgagcagtaactttctttgtgctttggaacattccacatccactcctctagttattttgaaatatacaaataattgttgttaactatagtcaccctgtaactacactgttaatgaacttctttaatcaaaagtaagttggacatgctagtgctggacatggcggctcacacttgtagtcccagaactttgggaggcccaggtgagcagatcacctgagatcaggagtttgagaccagcctggccaacgtgatgaaaccccatctctactaaaaatagaaaaattagctgggcatggtggcacatgcctgtaattgcagctattcaggaggctgaggcatgagaatcacttgaagctggaggcagaggttgcggtgagccaagattgcaccactgcactccagatgggtaacagagtgagactgtctcaaaaaaaaaaaaaagtagtaagttggacatgctaaattgttaacagctcaatttccctggggttttaccattagctatagttcttttgattatttcatcataactgaagccttttaaaagactggtgttttcatatacaaatatgtaaaatttttaagggtaaagctacaattaaatacatatgtaaggtattttagatccaaatgataaaatgcaatcctatgagtggtttttggacaagttgcttccggaagtatgccccaaaatgtctgtacacaccccagagaaattagcaatctgtcaaatgacgtatctgggcatgaagtaattgagtgtgttatcaaccttacaagtggccttgccaagtcactaagtcaaccccagaaaatctcattagcacctgcctttccaggtcatcaggaacaggtcgtggtgacccacggtgctatccccagtgatatccacagtgactggaatccatgaaaactcgtttacttaaaggatcagtttaaaagatctttttaaattggcccagaaatttataaaagttcattcttgtttgcttagggttcattactcatttatttaatagacatgggcctgattgataaaggaactgggaatgcatgtttaactaaaattacatagtacacacatatgcatatactgttgaccctgagaacacgggtttgaactgtgcaagttcacttatatgtggattttttttccaataaatatgttggaaaaatttttggagatttgcgacaatttgaaaaaagtcactaatggtagccttgaaatatcaaaaaaattaagaaaaagatttgccatgaatgtatacaatacacataggtagtagtctatttgtgtgctaatagactgtttatctgtaaaacttcggttcaacagtaggctattggtagttaagttttggaggagtcaaaagttatacatggcttttatagcagaaaaatattactaataaccgctataaaacatggcataagtaaaagttctaaattgatcattgtttatctacccagtacgggcactatgtctggcacacagtagggtgagagtagttataaatgcttgttgagtaggttcattactgggaggccgaagtctcccaggatttaactctgtgtttcaaatccctaaactgatttcataagcttcattacactcaggttaaatccacatgatcctgactaaactgcactacaactgaaaatgtactcatattcttttaccagctgaagtccatttcaagagtcactatagatcgtacaaaaatggtgaataggccacttgatattttggtatgtgatctaaacaatgtacagattgggttttcaataggttctcaaaaggcaggaagtgaaggagcaagctggtattcacctgtctggtttaggttatgtaggtagttaaactggatagcacaagacaaaaaaaaaaaaatttaaacccatttagtgacatgagttctccagactaatccggctgcaacattgctggagtagagaaagttactgctcaataccttttggtttcttatctttatatgggctgaagttagcattaatacctctagagagtaaatgcagatatggggccatacttgagaccagagacaatcttgacttagcggtaaacacaccatatacatccattctctgtcttgagcttacagcaacactaactggaaagtatgataaatatttacattaatactaatatttctttttgctttgtcttaaatgactatgctttttttacaaaaatctcttggtatctctcatgcatgtggaaaaatggactttttagtcactagcatgtcagttgttaactgacccctatccagtttccaaatagaatgtacaatctccctagttcttcgatgtgcatgactggcctttgatgttttaataagtccctgaaatgtatctttaaaaggaaaagggaaatatgcctgggaatagatgcgtgcttctgaaattgtgcataaaatagctatgtaagaaatataagcatcgaaagagtgaaacaccaccttatttctcctctaatcattaatttcaaggtgataagcatttattggttttttctagggcttgtattaaaccactgaacaattgtcttaaagtatactcctcacagaactaaagagtaaaaatagaaaatgttaaaatagtaacaaaatatttacaagatagccttaaaacataatctgtaccataaaacctacaagttaccaattactattcaattaaagttcaaccgtattactgaaatatacttctgattttgaaatgttgagcccaaatatgtgattgcatcttcatgctgcatattcagtgttcactaaaactttaattttaaatgttgcacttcagaaatgtaaaaggatgtccagccaatgtaattttccttcatcacttgtgatattgaccagttttaaagtctttggcctatttttaaaaagtgaggatagctgcatcttttctacttcatatacaacttttctacatgtaaccctcaaattacacattgcctagtgaaacagagccaaaaaatgcagtatcacctgtaccttttaattttattaaacttttttcaatcatgaatttttcaccgtcttccctttataaataaattctagtgacaaatcaagatttggttttattttgatgtaattcacctctcacttttgtcttcaattccttttaacctctctgtacgtgttctctgtgttcttctgtctggactgtctggctcccggtgccatctctgtgtaacgtgtatccattaacacagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgaggtaatatgagtctctttgaaccatgggcatattaactaaacacgtgggcaatgtcagctttactggtgtcttttaacattgtcttaatggaaagaaagctatgtgaaaagcttttttaaaatactaaggatttactgcaaatatctaggcttggaaagaaagctatgtgaaaagcttttttaaaatactaaggatttattgcaaatatctaggcttggtgataaaggtgatttgaggaattatctgtagagctttatgtgtcagatagcaataaaatgaaatcaggtaaggaccaaatgtatatgtctctcgaaagctacaatgtactttacaaatatctggtgtaatacttctcaaagttatttataatctagtataccctatgtctgtcctttggggatcaaaaattaggaaggaggtgggaggtttagaggaattttatgagatgattcttctctcttctgatagcagcttgtggagaggtcattatttactcatttacaatgtttattgtgcataaaggtttttaggtgaataccctcaggctgttaatgtagatatttaatttttgctggtctctttttgactaattttttctttgttataactatttgttcacagtacttttgccataaagattttgattaaaaagatttattataggataaaatcttactgcttctttcactattacagaatcactatttataaattaaattattataatgcttcagagtgttaaatagtgatatcccaaagctatctcttgggatgaacacattgaactaatagtagtgtaagatatctcaaagccatttgcaaatatgacatagggaataaaaatattacagatagtatgttttctagataatgcaataaaatgatataaaataataaagtagtgcttaacatatagtattatgaaattctttattgtctattatgaatatatttgtagaaagcatgttaaagctgctgtcattattgtaaatgaattttaacatggctatttttaaaagacagtgcagtcagttatagcagatataaaaatgtaagtttctacattacaggctttcaaaccctgagaggttaaatttctagaatttacaagtaaaatgatacccttgttatttccaggggttaacaaattagccttaaaactaaaaacatattaaaccatatactttttgtttaatatcaaaagtgaatgtgaattttaccgacaatttgatgactgagaataatctgagtgctcactgctgcactttctgtcatgtgtatattgccttttctctgggaaaagttaattttgttcacatctatcattatgtatccatcagactcaagtcttgttcttcttaattactatttcctgacaattatcttttagtttccttccaaagtattttgccaagtggaggagtgtgggtgtgactccccgatttgttgttcaatgacatttccaaggcagccatttgaattcacattatgcttttaactatactagagattcacttgaaaatactagacctctgttcaggagtggctgtgcatagagtaatggctgagtattgatgtctctggcctcttgcacgtctggtgcctcccagcacctgacgatgctccccgccgtgcctgtgtttcagcgagcccacagcctcggtgccccccgagtcggacgtgtaccggatgctccacgacaatcggaatgagcccacacagcctcgccagtcgggctccttcagagtgctccagggaatggtggacgatggctctggtgagcagccgctgacacctgctgaaacgtattgatagaggccactgcagggggcgggacggggacgacagcaaacatactgggaatgaaagtctaaaacttggttttcattgggagccaaatgaatttttgctcagaaggataggatatggatggtgcctcgtttaaaaaaggagattccaggacatgtccaagtagccaccaagtgaagtcacaaaaggacaccaaagacaaattgcattaatggtagtcaagggctagctcagcttacaaatcatgagatatcattttaaatgaatgttgtcaaacttctcagcctcccccccacactctggagtatcaccatcatcaaaaactaaacaatgctctaaaaacccttactgtgttccatgttctgtgcaaagtattttgcatacagtatcatgtaatcctcacaggaacttggggaggtgagcctattatttgccctacttagcaaatgagacgctgagagatgggcgggtggccttgtgaaaggccacatagccagtgagccacagacctgggtctccagcccactcccgtcatcttcagggctcctgccctgacctaggcttctccatgcccaaaagatatagactgtcctttaaaagccacacaaaaatgcaaaatgtcccattagggtggctattgtggcagacatggagaataacaagtattggtgaggatatggagaaatgggaaccctgtgcattactgatgggaaggtaacatagagcaaccctgggagaggatggcagctcctggaaaagttaaacacagaattaccatgtgatccagcaactccactcctaggaatataccccaaaacacttgaaagcagggactcaaacagattctttatttttttttttttcttttttgagatggagtcttgctctgttgcccaggctagagtgagtggcacaatcttggctcactgcaacctctgcctcccgggttcaagtgattcttctgcctcagcctcccaagtagatgggattacaggcacccaccaccgcgcccggctaatttttgtatttttggtagagacggggttttacctcttggccaggctggtctcgaactcctgacctcgtggtccacccgcctcggcctcccagagtgctgggattacaggcgtgagccaccacgcccagcctgtatgccagcatttatcttattcacaatagcccaaagagggaaaacacccaatgtccattgactgatgaatggataagcaaaatgtagtatacacatacaatgaaatagtattcagtcttcaaagaaattaaattctgacacacggcgcaccatgaatgaactttgcaaacattatgtgaagtgaaagaagccagacacaaagaggcaaatattgtatgattccatttatttgagagatccagaataggcaaatccaagagacagaaagtagaatgaaagttaccaggggctatgagcaggagcacggggagttactgtttcatgggtggggagttactgtttcatgggtacagaggttctgtgaggtgaagaaatagttctggaggtggatattggcagtgcttgcacaacattttggatgtacctaatgtcattgaattgcacccctaaccatggtgaaaatggtaaattttatgtatattttgctacaataaaaaataataatgccctctgctcctttgagcgtttttgtaacagtttcctccaaccacaacaaaataaatgttttcactaattccattctataatgccctatttcagaacagcgtcccttatgattgcatcagtcctgcccctctcggaatgacggtgcagatgcaacttcaggttaaagtgcacactttaaaatagaagccaagcacaggctgcggccagctgttccctagccataaatggaaacgctttgtttttcagatgaccgtccggctggaacgcggagtgtgagagctccggtgacgaaagtccatggcggttcaggcggggcacagaggatgccgctctgtgacaaatgtgggagtggcatagtgtaagtttcacttttaaccctggaatttacgatacagcttggcgacagttcatttcttctcctttaagactttatagactaaaggcaactgtgaaaaccaaatttctattcatcaacttgaaacgtaaggtccccaacatttagcacattgtgactgtcactccttagatatacctccaaattgtcacatcacatgagtcagcaattttgacttacaatttcagatagattctcatgaaaaaaaaaagatgcccaaatgtatgttgaaaagtcacgtctaagaatcaagacttcactttaaactcccccacccctgttaacgtatagtgtttagtaaatgcatacatgaactgtgtatacatttagtatacatagtatcctcctctgtataaacacagggaaacaaatacaggcaacaggatgttacttaaaatacattatccttacccagtgtaagttacacaaatgttgaaacaaaatattgaaaaactgtcagcttccattacaagggaacttttatttattcagagatagagccctgctctgtcacccagactggagtgcagtggcgcaatcttggctcactgcaagctccacctcccaggttcaagcgattctcctgcctcagcctccccagtagctgagattacagggacccaccaccacacctggctaatttttgtatttttggtagagagggggtttcaccgtgttggccaggcaggtctcaaactcctgacctcaggtgatccacccgcctcggcctcccaaagtgctgggattacaagtgtgagccaccgtgcccggcagggaccttatgtttaaatagccacacttgctagtgcaggatcaagtcaaccaagataattctaacatctccatggcattcgtgccatgtggccacgtccccattcccttattccattcctcctgccatgaactcacacactgatgtgtcctctgtccggttagccaggatacatcccaagaaggcagtgggggataagcctggttagggcaaaaggaggaacgtgagaccaaaaggtcaaagcagggcagggagctcggagcagagaggccctcagtaaaatacaacagtgcctgacgttaccagaagcaatcattgtgcctaagttggaataaactgttcacagtagaagccaatccacccaccccaaaggaattccatctctgctgtttgatctggttttttgttttgttttgtttttgttgttattgttgttgttgtttttgagacagtctcgctctgtcgcccaggctggagtgcagtggcgcgatctcggctcactgcaacctccgcctcccgggttcacaccattctcctgcctcagcctcccgagtagctgggactacaggtgcccacgcccggctaatttttttgtatttttttagtagagatggggtttcaccgtgttagccaggatggtctcgatctcctgaccttgtgatctgcccgccttggcctctcaaagtgctgggatttcaggcgtgagccaccacgcccggtcgtctttgatctgttttctcttgctccattgaatagaggctggaccacgcagacggaaagcaatcagagagactcttcattgggtagacaaccacccccgtcaaaagcagaatcttttgcagaggggttggtcttgtctccatcatgtctccctcttcaaagaaacgatggggaaagatcatgaagtaggatcctacaaattttctataaagtacttgtttgaaaatctgaaaaatagtcacacgtcaacatcagagagaaacacgggatggtttattgtggatatcctagatctccatgacaattacatacagtttcacggctgtgcctgctttcacagctggaggccattgtttcctgactgtgaaatagagaacatctgccttctctgttgggttctctcctttgtctcatatttttgctctgtggttttttaacttgagctcgttttcttccccaacagcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagattt

SEQ ID NO: 37282 - DNA, 70072 bp, Homo sapiens
aggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggtaggctgagcgccccggtggcctggccgccggtgccaggctaggaagcaagtggaggaggggcacgcttcaacaactgctgctctcttgtccggagccccagttgattctgtgacgcacgtgaagtttgaagaagaaaagcctaacagatacaagaaagtttagttcacttttagagctggcactgtactttgtgtctttgaaatcagtggttcttaaagcctggtttagaattgccacctggggagctagctgaatagctgcctgagccctactctggaccttgtgggtctcaggtggagtcgctgtgtttatattgttagtgaactcattaggggacttttggcagccagctttgggaaccactggcctagagcagcccaacgaggggcgctgtgcttaggaaatttgagtttaaaagttgattatgatggccgagcccagtggctcacgcctgtaatcccagcgctttgggaggccctggcgggtggattacctgagatcaggagttcgagaacagcctggccaacgtggtgaaaccccatctctactaagaatacaaaaattagccgggcatggtggcgcgcgcctgtaatcccagctacctgggaggctgaggcaggggaatcgcttgaacttgggaggcggaggttgcagtgagctgagatcgtgccattgcactccagccttggcaacaagagcgaactctgtctcaaaaaaaaaaaaaaaaaaaagttggttatgttaatagaaaatatcccacagtatctttgagtggcttttcttggaattaggaggcatcataaggccaaaaaactcaaaacttgcgaaatatcagagctggaaaatttcactgtgttcccacgatttctaagcctatacagataacatctaaatagtgcaaacaacacacaattgtttgtcagtccagaatgtttaattcagaattattaagtggttattgtggtctaggcactattttagatatttggcatggatgcgtaggaatggaactaataattttgtagggaagatggacaagaaagcaggtaactgtggtacagtgtaagaagggttgtctaaagcttgagaaggtggttacagaaagctaccgataggaagtaatgggtgagatgaatcttgggtaagagctggccaagttcagggtgcaggatggaaggtaagactgtataaaccaagagagttacaagaacataggtactgagttatgaaagtgtatatctggtgtgaggacttgaattccatgtctaggacatggaattcattgaatagtgtctggtgatgggattgattgattatggggccagatagaggaggatcttccatgcaaaagccacatttagattccatttggcaggttgtccattaaaatatttaagtagataagtggcatgatcctatggatatggtagaatcatcagtgtggtggcaatgtggaggatggattgatatagggaaaagactagacctaggtgacagtggagagttgagtcttgagatgaaggagtcaaagttagagttgtatgtaggaggggggcataaatacctgaggagcaaagattatagagttaataactgagtggaaggggaaaatggatgactttggagtttccaactgggcagaatatttagttaggtggaactgccattaatacaaagaaggctttggtgatgggttttgtatgaatcaccttttgctaggttgcgctttgtgtaacaaataatcaaaaaatctcagtaactcacaacagtaaatattagtctctcacttgattttgttttgtttcttaatctctcactcgtgttggtggcctttggttagctgctgctgtgactgttccactgcagggtaggttcaggtctgctccatgtgtcttcccattcctggactgaggctgaagagcagccctgaattaaacatgcccttctcatggccgaaggcacaggagcaagaggctgaacacaaattggatttaaaatccttgctggcatgtgatgaaattaatgtgtgctcacattagacaaagcaagtccatgagggtgggggagaatgggatgaatgatccagtttagctgtgtttcctgattacaaataaaagcaactataataagtaataataatggcaggaattttatagtgtacccaccatttttctaaaggctttatgtggttttactcatgtatttatcataatgatcctgtgcagtaggtacaattgttatttctgttttatagatgggaaaactgtggtatatagggtccaagaaatttgtctgagataacacagagcctgaatttgaagccaggtggtctggctcataactcttgagtccagggtcttaactgttgctctataatgcttctcactcacccagctctacctaggtgggttctatggttgaaaagatggggtgggaaacttgtcagtggctcagctccaattcattatgactgtcaggcactaacctctgtggttgctcagcttcacaagaaaattactaggttgtagaatgttgtttcgcaggtgattaaaacacacacacacacacacacaaacacaaacacctggcgtcctgagagatcaagatttgccaaatgcagtatcagtaagtagggaaactgaaagttgaacttggttttgccactaaactacactgcctcttggttagtgagtctcatcctaaggaggctaggttggttgataaaggattgcctgggaggtgaactgtagccagtactggctcttctgtgatttaagtctgatgggctgagcttggcacagatgttgcccagtctgtagaggcaaatgtcagcttcagtgggtcagtgcttttcttctttgacccactggttgcttaaaagtacgttgtttaatttccatatatttgtgaattttccagtcatccttctgccattgatttctagtttcattccattgtgattgaaaggatacttttgggccaggcatggtggctcaggcctgtaatcctagcgctttgggaggccgaggctggtggatcacctgaggtcaggagttctagaccagcctggccaacatggtgaaaccctgtctccactaaaaataaaaaaattacctgggcatggtggcgcacgcctgtaatcccagctacttgggagtgtgaggcaggagagtcgcttgaacccgggaggcggaggttgcagtgagctgagactgtgctactgcactccagcctgggcgacacggccagactccgtctcaaaaaaaaaaaaaaggatactttgtatgatttcagtcttttaaaatttattaagatttgttttgtggcctgacatgtagtctatcttggagaatgttgcctgtgcacttgagaaaagttacatacttttttctgctgttgtagggtgacaagttctgtatattgtgttagctccaactggttctttccctaataccatgctgcttccttgttttttattttctggattttgcagagcaagagaatgtagcagaaatcatgaccctcagagctcttggagctgtagaaaataggaaataatggagatatactgtagactgaatattcatctaagtttgaacagttaggaagttgcttagtgttctgtcaaacagaaggaactaaataactagagatgctaatcacatggggagcaaaatgtattagtgggccaagtctgaatttcaaagataattagctagttaagtattgttctaaagtaatatgctgaccaaacaaaatttaaaaatacagaagggtgaaaagttagtccctctacctcttttctacttctcactgtcaatatttccttgtgtattacttaatttgtgtatatatgccagcatagagttttgttctgtttttttttttttttttttgagatggagttttgctcttgttgcccaggctggagtgcaatgatgcaatcttggctcactgcaacctccgcctcccgggttcgagggattctcctgcctcagcctcccgagtagctgggattacaggcaagcaccaccttgcctggctaattttgtattttttagtagagacgagttttctccatgttggtcaggctggtctcgaactcccgaccgtaggtgatctgcccgcctcggcctcccaaagtgctgagattacaggcgtgagccaccacggctggccgagttttgttctttttactaatttatttatttatttgaaacagtcttgctctgtcacccaggctggagtacaatggcacgatcctagttcactgcagcttcaaactcctgggctcaagagatccttccaccttagttggtcaagtcgctgggacacaccaccatgcccagataatttttaaatttttattctttttatttttattctttttgtaaagatggaagtctccctatgttactcaggctggtctcaaactcctgggcttaagcgatgctcctgcctccgccttccaaagctctgggataacagacataagccaccacactcagcctgttctttttaaaacataaaataggatccttggccaggtgcggtggctcatgcctgtaatcccagcactttgggaggccgagatgggcaaatcacttgaggtaaggagtttgagatcagcctggccaacatggcgaaacccggtctctattaaaaatacaataattagctgggcatggtggcacacacctgtagtcccagctacttaggaggctgaggcaggagaatcgcttgatctcgggaggcggaggttgcagtgagccgagattgcaccattgcactccagccggggcaacaaagggagactctgtcccaaaaaataaaaatacaaaattaaaaataaaaataagatcctttttctccctctgggatttgtttttaagtgtactttgtcagtaagcaagcattggttggaatctcagatagtgactgatgggacaggaaaaataagatggtattctaaccttcaaaaagcttatattccttaaaataggaaaacaaatagagatcagtttaagttcagaaggtgtttaaggaagaaagatgttaaattgagtaggagtggccagaagtagagttgaagatgagataaaacatgaattaggcttacagaggagtaagatatggagagatggacaagtggggtggtgaagaagagcttgaacaagacaggcaggggtgaatcttttccatacgatccagtggcccagcgtggctgccacagatggggtggcccagtgtggcggccacacagagttggcacagaccactgttttttttttttttttgacctttattttggtaaaaaggaattgctttctaatatttctctcccctgtctcctctatttctgttttaggagaactacaagcagatgaaagcactagtaaatcagctccatgaacgagtggagcatataaaactaggtaaacacagcatttattccacagcttatgcctttacttaagatgtcctaaaatagttattgcttttaggaaaaatactggaattaagcttttgatattttttttttttttttgagatggagtcttgctctcttgcccaggctggagtgcagtggcgccatctcagctcactgcaacctccgcctcctgggttcaagccattctcctgcctcagcctcccaagttgttgggattacaggtgcctgcctccatgcctgtctaatttttgtattttttaaatagagacaaggtttcaccatgttggccaggctggtcttgaactactgatgtcaagtgatccatctgccttggcctcccaaagtgctgcaattataggcgtgagccactactcctggctgagcttttgactcttaagactatgcatttgttggtatgcaggcatttaattttatttttcctattacttggccagtttttctcttcatagagtactaccacttttggggggaaaagtaaagattcaaattcataaattttatgaataaataatttatttttaatttttattaattttttttttaagagatgggttcttgctctattgccaggctggactgaacccctggctcaagcgatcctctcatcttggcctcccaaagtgctgggattacaggtatgagccaccacacctggccagtgatttcttagtaggcatttaatatttcctccctaagtgctgaatctcagatggaaagcattcttcatatttgatagactgtttcagataacttttatcaacaagtatataatacttaaaattgtatataatacttttaatgtaaaattttacatttaggttagagtagtttaaatactggatctcaggagtataaaaatagtgaagaagactggatttggaaagtatggtctagaattgcttatttactagtttatttagagacagggtctcctcactctgttgctcgggctggactcgaagtcgggagctcaagtgatcttcttgcctcagcctcccaagtagctgagactgtacctgtgcccctgtacgcagctatggaattcatacttttgaagccattttagatcaaggtgttgtctccagaaaaagaattcaaactcttgctgaaatgaaagtgttttgttaggggtgataactcaattgttatgcccattttgagagtttgatttggtgaactcactgtcccccttagacattaagatggtgggttttggggccaggcacagtggctcacgcctgtaatcccagcactttgggaggccgaggtgggcggatcacatgaagtcaggagttcgagaccagactgagcaacatggtgaaaccctgtctctactaaaaatacaaaattagctgggtgtggtggcgcatgcttgtaatcccacctactcgggaggctgaggcaggagaattgtttgaacctgggaggcggaggttgcagtgagccaagatggtgccattgcactctagcctgggtaacagagcgaaattccgtctcaaaaaaaaaaaaaaaagaggtgggtttgactcaatggagggttgaggagtcctgtggcatcaggtgcctgctggggatggtggatgctgaggaaccgtggtgcaggctggtggccacaggagggtagaggactgagccggactccctggggaaggaggtagggagaagggggaaaggacaaacttggctgtcacagctttgccaagaattaaatgtcaggggagcttaattatgtgctctgtgagcctgcatcaaggataaccctctttctggttcttcctaataaaaccagaattcaccagctgctccaaattgtaaggccccactctagacagaattgctaaagagtgatgttgtcttaagtctctctctttttttttttttttactgagacggagtcttgctctgtcactcaggctggggtgtagtggcgcgatctcagttcactacaaccttggccccccgggttcaagcgattctcccgcctcagcctcccgaatagctgggactacaggcatgcaccaccacacccagctaatttttcatatttttagtagagatggggtttcaccatgttgtccaggctggtctcaaactcctggcctcaagtgatccacccacctcagcctcccaaagtgctgggattacaggcatgacccacctgtcactttgggaggtcaaggcaggagaattgcatgaagccaggtgtttgaaaccagcctgggcaacagagtgagacctcatcacaaaaatttagctggagtggtggcacatgcctgtagtcccagctgctgggaagcctgaggtgagaggatcacttgaatttaggagttcaaggctgtagtgagccatgctggcaccactgcactccagcctgggtgacagagtaagatcttgtctcaaaaaaaaaaaaaaaaaaggtcctacttggaagatcgtttgagattattttcttgcctaaataaacaaagaaatagctttctgaaatagctgaacatttcattagacaaagactatattaagatgaaattcttggacaccaataaaaataaactaatgttttaattattaaaggtacaatttgatacttctgttcttgctccattaccttggtttgccgagagtgggttatagatattcccaagaatactccagtgggctcttcagttataattttctttgtctgtcatgatgtgagcaatgttgagaagcactgaagacaatctctgagtcaaggaaggggacttttaaattgctaaagtgttcaactcacccagttgcaagcctaaaaagttacggatcactaatgtcatctttaggtaaatttactgcacttatcatggaagtaatttctaaaattttatttttacctggtacaaatgaagataggaattttccagatctatcatagcatgtatttaataaatgtggtggagatgaggcattatttgcaatatgtgagctgcagagaaaatactctgtaatttatgtaactactagtgaattcagaacatagactctaggatatactctaaaatcagggatagattgatttttttttaataccagtttttacatttacttcagaaaattggcaacttgtaagttgagtgaatgattattagccttttctcagaggatatgttgaacttttaaaaagtgctatattttggattaagtattatgtttttctggcattgagacctttttatcgtgtcaatctaatctaatctaatcacatttctatcataggaggtggtgagaaagcccgagcacttcacatatcaagaggaaaactattgcccagagaaagaattgacaatctcatagacccagggtgcgtacatagccaagtactgactcagagtgttctctgttccatagtactttattagacagtcttgtaaatcagttattttgaattctagttctcatcgtaagattcaggaacatgtgtttattgagagcctactatgtgtcaagcactatgtgttgacatgtttattgagagcctactattggtcaggtactagtgatatatcagtgaccaaaacagacacagatctttgctctactagagtttacatcatagcaaagggagacagaaagcaacagtaaagactgtaacttctggctgggtgtggtggctcactcctgtaatcccagcactttgggaggccgaggtgggcggatcatgaagtcaggagattgagaccatctggctaacatggtgaaaacccgtctctactaaaaatacaaaaaattagctgggcatggtggcatgtgcttgtagtcccagctactcgggaggctgaggcaggagagtcgctcgaaccccagaggcagaggttgcagtgagacgagattgtgccactgcactccagcctgggtgacagagcgagactctgtctcaaaaaaaaaaaagattgtaaattctgtagtgtgttagtaagtgacaaatgtcatgagaaaaagaaaaggtggcccagggtaaaggagaggaagatatagggcaagttgcagttttaagaggtggtgccaaggtaggccgcattgagaaggtgatgtctgagcaaagatttaaaggaggagagagagagagagagccttgtaactctctggggaaagagtgtttcaggcagagggaatggccagtgcaaaggccctgaggtgggagtgtgccaggtaatgctggtatgctcaaggggcagccaggaggctggggtggttgtggtggagggagtgaggggagaggagtaggagatgggtcagatcctgtatggccttgtgggttatcataaaggttttggttttcaccatgggagaaatggggagctattgtagggttttgaacaggagatgattatgatctgacatagcttaaaagagtgcttctggctgctgtgttgtgagtagatggagcagcaagggtggaagccctgtgaccaggtagagggcgattgcaaggatttgagggagacatgatggggactcggcatagggtagtagtagtggtggtggcaggagtgcagggttctggatgtattgtgaagacagagccaacccaacaggatttcctgaaggattggatatggagtgtaagggggagaagaggggtaagtgaaaactcccaaagtattttttctcctgacacgtgcacacacatccaacctggagacagcactgttaacacctagtatattatccttctaggccatttgtatgcatatatatataccagacacctacattttttaaaaatgcaaatgaaatcgtactaaatttgctgttttgtagccagctctcttttttccctcctaatgtatcttgaccatgtaagtaagtgagaggcggactagtggttaagagcctggcccctggggcaagattgcttatgaagctcccggctctgccccttacttactgtgtaaccttagacaagtgacttgatctctgtgtgtttcagtttcctcatcagtaaatgagggtcacaataagatccacctcagaaggtggttctaaggaggacatgagtgagtgtttcttttttttttttttttttttgagacggagtctcactctgtcaccaggctggagtgcagtggcgcgatctccgttcacttaacctccgcctcctgggttcaagcgattctcctgcctcagcctcccgagtagctggattacaggtgtgcaccaccatgcccagctaatttttgtatttttagtagagacggggtttcaccatgttgcccaggatggtctcaatctcttgacctcgtgatctgcccaccttggcctcccaaagtgccgggattacaggcatgagccaccacaccagccgataagtgagtgtttctaaagcctttagaagagagcctggtatttggaaaggatttttattttaattaattaattaattatttattttttgagatggagttttgccctgttgcccaggctggggtgcagtggcatgatctcagctcactgaaacctctgccttccggattcaggtgattctcctgcctcagcctcccgagtagctgggattacaggcacgtgcctccacgcctggctaatttttttttttttttttttttgtatttttagtagagatggggtttcaccatgttatccaggctggtctcaaactcctgacctcacgtgatctacctgtctcagcctcccaaagtgctgagattacaggcatgagccaccgtgcctggccattagttgttttttgagacagggtctcattccattgcccaggctggagtgcagtggcacagtcacagttctctgcagccttggcctcctgggctcaagtgattcttccacctcagcctcccaagtagctgggaccacaggcatgtgccatcatgcccagctgtgttgaaaatttttttttttttgtaaagatggggtttccccgtgttgctcaggctggcctcaaactcctgggctcaagcagtccacccacttgagccccacaaagtgctaggactacaggcatgagccaccccacctacctccaaaagtttttaagagatggggtcttggctgggcgtggtggctcatgcctgtaatcccagcactttgtgaggccgaggtgggcagataaccttcaggtaaggagtttgagaccagcctggccaacatggtgaaaccccgtctctactaaaaatacaaaaaattagctggttgtggtggcgcatgcctgtaatcccagttactcgggaggctgaggcaggagaatcgcttgaactcaggaggtggaggttgcagtgagctgagatcgcgccactgcactccagcctgggtgacagggcaagactccatctcaaaaaacaacaacaacaacaaaaaagagatggggtctcactatgttgtcctggctggcctccaactcttgggctcaaacagtcctcttgtctcagcctcctgaataactgggattacagacttgagccaccacacccattttagatttttaaaaatagattttatatacaacatgtgtatttgaaatattgtcccattgaggaaaaatcttttccttttccatgtgtaactgtttaaatgtgtagtttttaatgacattaattcaaacaacatcctttcttcgctttaggtctccatttctggaattatcccagtttgcaggttaccagttatatgacaatgaggaggtgccaggaggtggcattattacaggcattggaagagtatcagggtgagtattctacttgtgcttcataatgtgggttgagaagaagactttgatgaggcacaggcatccagcactcactttgcatattagcatgcgatttgtatgctatttatattatgtaggactggctgggtgtggtggctcacgcctgtaatcccagcactttgggaggctgaggtgggtggatcacctgaggtcaggagtttgagatcaggctggccaatgtggtgaaaccctgtctctactaaaaataaaaaaataagccggcatggtggcacacgcctgtagtcccagctacttgggaggctgaggcaggagaatcgcttgaacctgggaggcagaagttgcagtgagctgagatggagccactgcactccatcctggtgacagagcaagactccgtctcaaaaaaaaaacaaaaagatgtctttccatggagacaagggcaaggaaggagaccagtctttatcttttaactagagatgctctagtactggatattatggctgaaaaaaattcagtcatttaataggtataaagtagtacttaattataaattctttcttttttccttttttgttttttttagagatggtgtctcgctctgttgcctaggctaatctcgaacttctgggctcaaacgatgttgaatataggctagcacatcattataattttttttttttgagttggggtcttactctgttgcccaggctggagtgcagtgacatgatcatagcttactgtagcctcaaactcctggcatcaaatgatcttcctgccttggcctcccaaagtgctgggatcacaagcatgagccattgctctggcctttattataattcaaattgacctttcttacataaaaattgttgaatggtttatatcatcactactctttctctgacaaatgacagatgagctgaatttgctcaaattaagcaaaaaagaggatatattgattctcttatctggtgagtctgggcatggctgtatctgggagctcaaatggtcttaggtattactaggtcccaggctgttttctactcctggccctgacttgctgtgtgtcagctttgtttctaggcagcctctctaaatccagaggcagtgatggtcataggcagttcctggtttatattctataagtttagcagctgcagtggaaggcaagatctgcttaggcttagagcctgtcccattgccgagcctcagtgggaactctgggtagaaagacctggtccctgtgcccccctttaaggcaggctctggggtcagtcctacttgagccacctggattaaagataagaggcagtttctgaaagaaggtttagttttgttgccaaaataatagatgctgggtaggcaaaaccaatagaaatgcaatctagtatttttgtgggccaatttgatttctcattctgtaacaagtctgtgacctttaatagacaagcagatatggctatgtcccttgtccatggtcacataactaacaagttggcagagccagaatttcagtctaactttgtctgacttcacagcctggcctctttccagtaccagagcttcttaaactttctagcgtagcacccccagtggtaggaagtatgagcacacactctggagtgtgaggttatggcccagcaacctatgagaagcctacatttcctttgaagtctagttcgtttaatgttaaatcattaaaagtttgcattctactctataaaatgttcattgcagtgcagaaaaaggttttatatgacctagggaataaaattgatgctcaaagaagagtcctgtttgtcttgtggcgagccctgctggccacatatcctagtatgagaagctcaacactaccctgtgctgggtgttcagttgccgttctctattttcagcagggatttaatgactcactctttagagttgtaggcagcataaagtgaggtaacacaaacatcagaaacataaagaaaattgaattttgtaaagagcacactgttgtcatctcagatttcaagggtacctctgaccttaaggtttcctgccagtgctgtacagtttccccaaccagctgtggttgttggccgccctgctctttgtgactcatacccaataaactggttttggtgagaaagggcactgttgatgactcaggatacctttcatgtgtttttagtatattaaagtttgcattcattctgacttcagttaagatgaacgttatattttagactacatttagttttgtagaaaaccatggggctgtaatgttgaagaacaagaatacaaaaaataaatcttagtactaaaggtcagttttcatttttgcaaaataccctcctaaaaggagactttgaaggtttattatgagggaattcttttcccttgagacttggattttttttttcattattattttcatcttattaggaccttttcattcaaagaaccattatgacacaaggcttaggttgttagttttttattactaatctaggactgatgacttttcaaaaaccaagtgtgagtttataaacttgttagaagtaattgttttgtattatataaattaatatgtgaactgtgattaaagtttgcatttatatcctaagactgctgtctgctaatggatgttaatagtgatacgtactagaagttgaaggttgtattggggtatcttgtaatgagtgtaattagttttgaagaaatctcttaaattctctctccaatgaaatttctgcctttcagagtagaatgcatgattattgccaatgatgccaccgtcaaaggaggtgcctactacccagtgactgtgaaaaaacaattacgggcccaagaaattgccatgcaaaacaggctcccctgcatctacttaggcaagtcaccagagtggtaaaataaactattattagctggtaaaatgcaagatagtttggaaggctgtatgtattacatttgggatgggtattttataaacctgttgatttctcctgtaattataaaggaaacacaggttctttgctgaaaactctgggggaaagtaaacaagaactgttcatagtactagtgcataatactcatacattttgacgcatgccagtttttttctctatgtgttgtgtggttttttttttttgttctctagatcctgtttttcttttaactttatggatcatactatgaaaaaaatagtagcaagtatttatagatctcttgagtgccaggtactgagttaaatgtgcaagtattatataatttgagcagatgtaatttaaagtaaatttaatttccagtgaaagtaaacttatatttgaaattaaaacacatttaaatcaaagaacctgaaagcaaagcagtttaaaatgggcctttcctccgggcgcggtggctcacgcctgtaatcccagcactttgggaggccgaggcaggcggatcatgaggtcaggagatggagaccatcctggctaacacactgaaacctcgtctctactaaaaaaaaatacaaaaaattagccgagcgtggtggcaggcagctgtagtcccagctacttgggaggctgaggcaggagaatggtgtgaacctgggaggcggagcttgcagtgagctgaaatcgtgccactgtactccagcctgggcgacagagagagagactgtctcaaaaaaaaaaaaaaaaaaaaaaaatgggcctttcctgatactgggttagtctgataaaattccaacatacgttgttcatgtatgcaggtatttgaacgggtactgatgtagaggtattttttgttttgtgtttttctgtgaagttgaatttacctgattaactcacaatacgaactgctctgcacgtagagaaaacagcaaatgaggcccagctgcttgtaggtgctgtgctggtctttataggggatacagtgaggaggattttgttgtctctgtcttcagcgagctcataatgaattggacacagcatataatgtgcaaccaacaaaagacttaatggttgcagattctgaactaagtgctttctatacatttttcaagtcatcctaatatatgatatggctcctttttttatcttcatttcgtgggtaaggaaaccggggcataggatggctaggaaacacacctataatcacacagctgtgaagtcatgagctctgctttgaacgcaactgacctgtgtacccaccactccaatctgcaatgaaaacagtatcagaaggcaatatgtataaattattatatgaattctgtggatggcttttgtattggtttagaagaaggaaagatacttttccaccttaactctttaagaatttatgatgtttctggggctttagctggtcctcaaaggagagaaggttctaaccatttcgagaagaattttgcacagaggtgggaaagcctgatgggtttggggcaatgaatccttttggctgcattgggggtttggagaacgaggctctataacagtttagaaagacagggcaagttttttgtgaatgtgattaagaactgatgctgtcattgatacaagtttccctctgcgtagcacatttagttcatagagatgcttatgtttctcatttcttgtcttcagttgattcgggaggagcatacttacctcgacaagcagatgtgtttccagatcgagaccactttggccgtacattctataatcaggcaattatgtcttctaaaaatattgcacaggtaatttttcatgaataaagtgtacagtggtgctttttactcttaagtatctttacgaattaggtactctgggatggcttgaaagtaaaacagaatttaacacaaaatctaatcttttttttttttttatactttaggttttagggtacatgtgcacattgtgcaggttagttacatacgtacacatgtgccatgctggtgcgctgcacccactaaatcgtcatctagcattaggtatatctcccaatgctatccctccccgctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatttttggacatttgggttggttccaagtctttgctattgtgaataatgccgcaataaacatacgtgtgcatgtgtctttatagcagcatgatttatagtcctttgggtatatacccagtaatgggatggctaggtcaaatggtatttctagttctagatccctgaggaatcgccacactgacttcgacaatggttgaactagtttacagtcccaccaacagtgtaaaagtgttcctatttctccatatcctctccagcccctgttgtttcctgactttttaatgattgccattctaactggtgtgagatggtatctcattgtggttttgatttgcatttctctgatggccagtgatgacgagcattttttcatgtgttttttggctgcataaatgtcttcttctgagaagtgtctgttcatgtccttcacccactttttgatggggttgtttgtttttttcttgtaaatttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgtttcggacatgaagtccttgcccatgcctatgtcctgaatggtaatgcctaggttttcttctagggtttttatggtttttggtctaatgtttaagtctttaatccatcttgaattgatttttgtataaggtgtaaggaagggatccagtttcagctttctacatatggctagccagttttcccaacaccatttattaaatagggaatcctttccccattgcttgtttttctcaggtttgtcaaagataagatgtaggtatgcggcgttatttctgagggctctgttctgttccattgatctatatctctgttttggtaccaataccatgctgttttggttactgtagccttgtagtacagtttgaagtcaggtagtgtgatgcctccagctttgttcttttggcttaggattgccttggcgatgtgggctcttttttggttccatgtgaactttaaagtagttttttccaattctgtgaagaaagtctttggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgagagttcactcatgatttggctctctgtttgtctgttgttggtatttaagaatgcttgtgatttttgtacattgattttgtatcctgagactttgctgaagttgcttatcagcttgaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttactgatttgcatatattgaaccagccttgcatcccagggatgaagcccacttgatcatggtggataagctttttgatgtgctgctggatgcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctactgattggaatagtttcagaaggaatggtaccagttccttcttgtacctctggtagaattcggctgtgaatccatctggtcctggactctttttggttggtaaactattgattattgccacaatttcagctcctgttattggtctattcagagattcaacttcttcctggtttagtcttgggagagtttgtgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaacgtgtttgctcttgcttttctagttcttttaattgtgatgttagggtgtcaattttggatctttcctgctttctcttgtgggcatttagtgctataaatttccctctacacactgtttgaatgcgtcccagagattctggtatgttgtgtctttgttcttgttggtttcaaagaacatctttatttctgccttcatttcgttatgtacccagtggtcattcaggagcaggttgttcagtttccatgtagttgagcagttttgagtgagattcttaatcctgagttctagtttgattgcactgtggtctgagagatagtttattataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgactctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagcatttagtccatttacatttaaagttaatattgttatgtgtgaatttgatcctgtcattatgatgttagctggtgattttgcttgctagttgatgcagtttcttcctagtcttgaaggtctttacattttggcttgatttttgcagtggctggtaccggttgttcctttccatgtttagcgcttccttttttagggcaggcctggtggtgacagaatctctcagcatttgcttgtctgtaaaggattttatttctccttcacttatgaagcttagtttggctggatatgaaattctgggttgcaaattcttttctttaagaatgttgaatattggcccctagtctcttctggcttgtaggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctgtgtatttcctgaatctgaacgttggcctgccttgctagattgtggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttacagttgatcgcttcagctcctgaggcttctgcattcttcacgtagttctcgagccttggttttcagctccatcagctcctttaagcacttctctgtattggttattctagttatacattcttctaaatttttttcaaagttttcaacttctttgcctttagtttgaatgtcctcccgtagctcagagtaatttgatcgtctgaagccttcttctctcagctcatcaaagtcattccccatccagctttgttccgttgctggtgaggaactgcgttcctttggaggaggagaggtgctctgcgttttagagtttccagtttttctgttctgttttttccccatctttgtggttttatctacttttggtctttgatgatagtgatgtacagatgggtttttggtgtggatgtcctttctgtttgttagttttccttctaacagacaggaccctcagctgcaggtctgttggaataccctgccgtgtgagatgtcagtgtgcccctgctggggggtgcctcccagttaggctgctcgggggtcaggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggggagcctacagaggcaggcaggcctccttgagctgtggtgggctccacccagttcgagcttcctggctgctttgtttaccttaagcaagcctgggcaatggcgagcgcccctcccccagcctcgctgccgccttgcagtttgatctcagactgctgtgctagcaatcagcgagactccgtgggcgtaggaccctccgagccaggtgcgggatataatctcctggtgcgccgttttttaagctggtccgaaaagcgcaatattcgggtgggagtgacccgattttccaggtgcgtccgtcacccctttctttgactcggaaagggaactccctgaccccttgcgcttcccaagtgaggcaatgcctcgccctgcttcggctcgcacacggtgcgcgcacccactgacctgcgcccactgtctggcactccttagtgagatgaacccagtacctcagatggaaatgcagaaatcacccgtcttctgcgtcgctcacgctgagagctgtagaccggagctgttcctattcggccatcttggctcctccccaaaatctaatctttttccacagagagtatctaaaggttgtctccaattagagctttttattaactataggaatactcctatactgtaataagattattaaaacaggttttaggccaggcgcggtggctcacgcctggaatcccagcactttgggaggccgaggtggggggatcacgaggtcaggagatcgagactatcctggctaacgcggtgaaaccccgtctctattaaaaatacaaaaaattagctgggcgtggtggcacatgcctgtagtcccagcaacttgggagactgaggcaggagaaatgcttgaacctgggaggcagaggttgcagtgagctgagatcatgccactgcactccagcctggcgacgaagtgagactccgtctcaaacaaacaaagaacaggtttttaaaaggaaaacagggtttaaaaagaaagggctccagtaattccttttttagggctataccctagggaaactctgatatatgtatgaagagatacttagaagaataattcatggccaggcactgtgacttgtgcctgaaatcccagcactttgggaggctgaagtgagaggatcacttgagtccaggagtgagagaccagcctgggcaacatagggagaccctgtctctacaaaaaaataaaaaattagccgagtgtggtgtggcacatgcctatggttccagctttcaggaggctgaggtaggaggatcacttgagccttggagtttgaggctacagcgagctgtggttgcaccactgcactccagcctgagaaacagaatgagaccctgtctcacaaaagaaaaagaaaagaaaagttcattatagcattgtttgttagagcaaaagttagagaataacctaactgttcattcatgggagattaataatacagtttttgtctgttaaaaggaatgaactaaaattgcatctgtcaatataagtctcaaaaagtagattgagtaaaaaacatagtagaatcaatatatggctatttactatgtatgtaaaggttaaatacatcgaatcctactgtatattatttgtgtataaacatgcacgtgggagcgatacactcagctttagaacagtggttgcctctgaggtgggaaggaagagacagggatgaggtaggaggtagataggcgcttcaactatatctcaaatactttattcctttttttttctttttttttttttgagatggagtcttgctctgttgcccaggctggagtgcagtggtgctacctcggctcactgcaaactttgcctcccgggttcacgctattctcctgcctcagcctcctgagtagctgggactacaggcgcccaccaccatgcccggctaattttttgtatttttagtagagacagggtttcaccacattagccaggatggtctcgatctcctgacctcgtgatctgccgacctcgtgatccgcccgcctcggcctcccaaagtgctgggataacaggcatgagccaccgcgcctggtcaaatactttattccttaaaaaaatgatctgaagtaaattttgcttaatgtcaaggtttattaagattaggtattaggctaatggatgtttgttattctgtaattttttttgcatggttggaatatttataatacagatgctgctattgtgttttcatttctttattggatttaagtttgtcatatttttattaatattctgattaatctatacttgcaattattatatatctttttgatttttctatcaacatagttggttgtaattgtttatggtatattttactgttacacagtgaccatgcctacctatatgctttatttatctaaatagaaacttcggctttgcttacttttgcacagatggccgttgcattatctatatgaaattcgtattgtggtctccatttaatctggtattatatttttttcttttagagaaacaggatcttgctatgttggccaggctggtctcaaattcttggcctcaaggatccttctgccttagcctcccaatgtgctgggattacaggcctgagccaacatgctgggcctggtgttacaatttttatagcttaccttttattagtttcctagggctgttgtaacaaattatcacaaattgagtggcttaaagcaacagcaatttatgtatttatttagagatgaatgtcttggtatgttgctccagctggtcttgaactcctggcctcagatcatcctcctacctttgccttgtgggtagctgggattataggtgtgagccacaatgcttggctaacagaaatttattctgtgaagttctggaagccataactctgcagtcaaggcagcagcggggctgtgcttccaggggacattctgttcctttcctagcctcttccagctcctggtggctccaggtattcccctggcttatggctacctccctcccatgtctgcctccatcttcacgtgaccttctctgggtatctgggtcttctccttctctatcttataagaacacttgtcactggatttagggaccacccaggtaatccacaagattcttaattatatctgcaaagattcctttttcaaatgagaccatctttacagattctggtgattaggatatggctatatctttttatcttttgttgggggaggctactatttaagcactatagccctctatcatctaacatgttctttgctgtgtctttctgctgccaggtggagtctctattcctgtggaactttgaagtttaaagtgctttaaaatcagatcttttaaaaatcaaaagtgtacttacttcttggaataagcaatacctgcttatgataaaaaactcaaaatgtctgaagggcatttgactgaatgactgtcttccttttacttattttatttttgttttttaaaaaatattagggctgggcgtggtggctcatgcctgtaatcccagtactttgagaggccaaggcaggaggattgcctgagcccaggtgagaccagcctgggcacacacctgtggtcctagctgtttgggaggctgaagcagaaggattacttgagcccaggaggttgaagcttcagtgagccatgattgtaccactgcacttcagcctgagtgacagaatgagacactgtctcaagaaaatatacatatatttataatatataatatatcagagaaggaaggtggagtaagtactagtgttttcagtatgaagaaaagtgctcacacatagccggacatcttcagtgcagatttcaggtttagggctcatatattcaggaaggggtcagaaaagatactatggagactcaatatatgataacagaaatttctttttaaattccaagaggttcatattatatatctaattcatattatatagttcatattatatatatatggttcatattatgtataacgtatataatacacacacacacacacacacatatatcagtatttctttgagctacttctcttagcctttatttttttctatttcccttaaataggaaaggaggtttagggttaaggtttgccttctcatattttaatgaaccgtatttttaagtttccatagtatctgttctgagcctttcctgaatatatgagcctaaacctgatatctgcactgaagatgtcaggctatgtttctcctcttctcaaaacctaaacccgtcatttatgattttaatactaacctctcctttttgcttcatcatttattccctttctcttactctaattaattttcttgggcaaggcacggtggtccacacctctaatcctagcactttgggaggctaaggtgggagattgcttgaggccaggagtttaagatctaacgtggccagcatagtgagaccccatctctctctctctctttttttttttttttgagatggagtcctgctcttgtccccaggctggagtgcagtggcgtgcaatattggcttactgcaacctccgccttccaggctcaagggattcttctgcctcagcctcccgagtagctgggactataggcacatgccatcatgcccagctaatttttgtatttttagtagagacggggttttactatgttgcccaggctggtctcgaactcctgaggtcaagtgatctgcccgcattggtctcccaaagtgctgggattacaggtatgagccactgtgcccagcccagaccccatcttttaaaaatgaaaaaattttttatctgcttatttttcttctcacaccccaaaatcacgttgataccttttctttaaaggaaacaaaaaaagaacactaaaatgatgccaaaagataaagaccttttctagcttctgctgtttttgaagcttttctccctacctgggtggctacatttttttccccctttgagatggagtctcactgtgtcatccaggttggagtgcagtggcacgatctcggctcactgcaacctccacctcctgggttcaagcaattctcctgcctcagcctccctagtagcagggactacaggcatgcaccaccatgcctgactaacttttttgtatttttaatagagatgaggtttccatatgttggccaggctggccttgaactcctgacctaaggtgacccacccacctcgacctcccagagtgctaggattataggcgtgagccaccgcgcccagccaacattcttaaggattggcacattgtcttcattctaactgctcactccttcaaacctccatgccctacgagagtttcaccagcctagagaccagattcccactctgcacagcctcttggtatcatcatttttttccttttcgtgaaattctccttatgcttcatgccactggggtgcccttatttatttatttattttaacgatttagccagatctcattacctgtcatctccctgatctttatctagtcttgaccacctctacatctctacttttgaacctcgggggttctgctttctcagtcaatttcctgctggtaccttagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgtaagtaaagtgtttccctgagttctgtgggccactcttgtaaattagtcaaacccaaggatgggtagtggcagccctgatttacagtcaatcagaaatataggtgacaacctgctccttgtggattggcatctgaagtgagggccatcttgtaggactgagcccttagtctgtgggatctgatgctgtctctaggtagactgtaagaactgaattggattagaggacagctggtgtctgctggagaactgcttggtgtgtggagaaatacccccacatatctggtgtcagaggtattgagtgactgtgtcagacagtaggaaaaacactttttcctctgtcttttcagacttaggttcaaactagacattgaacacattaacttcccctactcatttgttccctcacctgagttcccatctactgctagcactaccttgctctttccctaggacttgatgtcatccttggctcttttctctgcattttcccttacttaatccttttaggtcaaaaatatacatctttgacatttttgtatccctggcagttgctctgatgccgggcacaaagtgaacacatcctaagcctttgcctaatatattgatgagtcctgttggtttcacccttgggcagttcctctccactctgttcctactatcacccccagaggcagctcaggcctttgttaccactagactgtggctctagcctcacctgcctggtgtccctgtctgcctagtctatcctttcccatacagtggacacatgctgcaaggttattctttatgtggccctcctgttactatttgctacaaaacaaagctcatacttcttagcccgatacttaagcccccgtgtgatcggatttcaacctaactttctagccttattgctcctggaccctaaactgcagtcaacctgatgcagtcactggtctccatatataccatagccttttttgaccatctgctcaggcccatgctggtcctctttcccctcatcctcctgggtcggagtctccaacccatcttccaagacacatctcaaatgccacccttttaaggaaatcccggaatcctttactggaagtaatattttcttcctcctagctcccatagttcttgtactgtgccttactaatagcatttatccctttaatctagatatatctggactaatttcctctactagtctgttagctacttgagaatagggacaatttagatgaatttttatatcctcacacatttccctgagatggtacttacttaatatttattaaaagataaatctccttataactattaaagttgtaatatgatagatattgagtggttctgtttcctaagtttaatgtttgttttgttgtttatttaagactttggtttagacagactgataaaacaattccttatgtttattatataagttaatcacttctaacttcaattatgttatgtatttatttcgatagtaagcaccagcttccttactcaaatttagttgtttttctctccaaggttggtttttatttaatgttactagccttgcccattgtaaattcatttacctagttatttcaaagagtatgtctattggcaatcatacccgtatcgttttctgtatctttgctgctataaaaatgtggacagattactatagaccttccaggtttcaacattttcttttgctctcaaggagaaaagatagttaaactaggtacttacttttatgttctcttctgtttcatctttccttcatggcagattttaagaccccttaatcgtttctggagtttaaagagttgatgtgtgggtgtctggtggtctttctttgagtctcatgtcatgagaatgccttctctgggccttctccatatctgaggcctgatgacatgatgatctttgcaatgttcttcttttattttcccagtggtgcagtttaaatgtgtcccccaaaagtttatgtgttggaaatgtgattgccattgtggtgatgttaaatggtggcacctttgggaggtaattaggtcatgagagctctgccctcatggatggattaatgctatcattgtgggagtttggccttcgtttgctctctgtctcacacacacttgccctctcttgccctcccaccttctgctgttccaccatgggatgactgtcagatgccagtgccatgctcttggatttcccagcttccagaaccgtgaaaagtaaatttcttttttaaattctttctttctttccttctttccttcttccttccttccttccttccttccttccttccttccttccttccttccttccttccttcctttctttctttctctttctttttgtagaggtgaagtcttgctgctcaggctggtcttgaactcctggcttaagttatcctcccacctcagcttcccaaagcattgggattataagcatgagccactatgccaggccaaatttcttttctttataaattactcagtcttgggtattctgttatagcagcagcaaacagtctaagacaccaattatggtttccatgtctggctttttaagtgtgagacttagaatcctcctcagaagtgggatcttcatgtgtgttttctttaggtctcacattacttttgatttttataattgagtgatagtctagtttgctgtagattgatctttgctctggtgcattggttctctttcttgttttagtataagcaacaaggtttttgtttgaatgaacagtttgtttcttctgaaataggcatcattcatctagccatgcttagttgcagttcctcaggcctttctcttttcctttgtgttgtattctgcctattttcacttctttttggagacatatttaaaattattctcaggtttccctttctcccccctaccttacctccctcctcctccccgcttgccttagcttattatttttgaaatgtatcttgttggttttcactgttttgaccttggtaattgttttgaggagcttagttaggataggtactgcatcctttttctttttttcttttttttaaagacagggtctcactctgttgcccaggcttgagtgcagtggcacaatcacagctcactgcagccttgacctctcaggttcaagtgatccacctgcctcagcctcccaagtggttgggacttcaggtgcacaccaccttgcctggctaatttttatttttatttttgtagagatggaatctcactatgttgcccaggctggtctcatacttctgggctcagggaatctttctgccttggcctcccaaagtgctgggattacaggcatgagccaatgtggcctctcgttgttttatttgtttatttatttttcgggacaggtctctttatgttgcccaggctggtcttgaactcctgggttcaagcaatcctcttgcctcagcctcctgagtagctgggattacaggcgtgtgctaccctgcttggcttgttttaaaaatgcatttcaaagcaggcacggtggctcacacctgtaatctcagaggctgaggtgggcagatcacgaggtcaggagatcgagaccatcctggctaacatggtgaaatcccgtctctactaaaaatacaaaaaattagccgggcatggtggtgggtgcctgtagtcccagctactcgggaggctgaggcagtagaatcgcttggacccgggaggtggaggtcgcagtgagccaagatcacgccactgcactccagcctgggcgacagagtgagactctgtctcaaaaaaaaaaaaatgaatttcaacctgtgatggagatggatagggcctaggagaaacaaaatcactgtttgatttctttgaggctctctgacaaaaagattgaggaggaaacagaacatactggataagactgactttttggattctttgtgcatttcaatctatccagttggcataggtaagcatgactactatcaaatcagtggtattgatcagtcagtatagttgataacgttcttaaattcttgacagctattgaattgagatgtatattttgtggcttttattttttaatggtggctcttcaggtaggggcaggaaaaatgggatgtgggcagtaatatctgctttctactttgaattgaaaaagaagtaaggtgacagatttaaaaaattattatatttttaatggcttttctatcaagcagttggaccttttttctccctccaagttatattacatttatcacagcatttctatgaattggatagtattctacaattttgcagggaggaactgaggtctagagttcacctagcttttcagaattagataaaaaatctcttagctctctgtcagagaccctttccatggggcaggctgttgacctacaatatgtaatttgcttttggtgcaaggagacccagtctctatttgtttaggcaagacctagagggtaatgaaattcaatctaaagcttttctggatgattacctctgttttgtagcatctcatttgcttttgcttggaaatgttgcctgtgccttctgtggaggggatgacaagtattgttactgtcaggtatgtctcatcctcatccttcttgcacgttcttactcttgattcaagtcttagaatcacctcaccttgcaagagtgatctctgtttgttcctgtcacagagcaggcccatctcactggtgactgggtggacggtagtctctcagtggagttctttggagttcacctctgtcctgatgcagatgcaggtccctgtgatgtctgtcctggtacaatgcctatgttgtgccacatcacaagccaaatctctgcctctgagtctggtcagaaaagtttctggtcatgcatcttatgtcttttcagtgtccttaggtaacgtctttgtggtaccaccagtgaatgctttgggacatggcaagttgttaatgctgtttggccctgggatccctgtgctttgtgagagaaagaagcagatacaggaagaagcagatacagctgggcacggtggctcatgcctgtactctcagcttcttaggatgctgagaggtaggaggattgcttgagccaggagtgctacctgggcaatattgggaggcctcatctaaaaaaaataaaaataaaaaagaaagcagacacagtggcagaactcttgttccattcactttgtcaccttttgggagtaagtgaatgactcagaactaaatgacaaggattattagttgggcgtggtggtgcacctgtagtcgcagctactcagaaggctgaggtgggaggatctcttgagcccgggaagtcaaggctgcagtgagctgtgtttgtgccactgcactctagcctgggcaacagagtctcaaaacaaaaagagagaagagattgtatgacattgagtgacagtgactaatcattaattagtgagctcttttatctctgttttttaatttaatttttatttctgtcatcagaatttgcttttagcaatattaagattttgcctgttgattaccagaggctgggaatgggagtagaggttgggggaatgtgaggatggttaatggatacaaaaaaaaaaagaaagaatgagtaagacctattatctgatagcacaactggatgactgtagtcaataataataacaactgcacatttaaagtaacttaaagtatgtaattggattgtttacaactcaatggataaatgcttgaggggatagatacccattcttcatgatgtgcttatctcacattgcatgcctgtatcaaaacatctctcgctgggtgtggtgcctcatgcctgtaatcccagcactttgggaggtcaaggtgggaggatcgcttgagcacaggagttcaggacctgcctgggccaagtttctggtcattcatcttacatcctttcagtgtcctcttagtggagaatgccatagaattttctttctagggtttcagatcacttgtccagtgagctttgtccagtgtaggctcatgtaacgtctttgttgtaccacagatgaatgcaacatggcaaaacgccatctctactaaaaaaaaaacaaaacaaaactcaggtaccccataaatatatagacctactatgtacccccaaaaattaaaaataaaaacaagattttgcctgttagatacttgtttgagaattttgactcctttgtacttatttttttgactcattaaaaaaatttttttacagcttcgttgagatataattcaaatatcatataacttacccatttgatgtgtacaattcaatggcttttaggatattcacagagttgaatgaatcaattttagaatattttcattcccccaatagcagtcactccccatttctacccagtcccctgcagccctaggccaccactaagctactttctgtctatagatttgcttgttctggacatttcatgtaaagggaatcatatgataagtagtcttttgtgactggcttctttcacttaacataatggtttcctggtcttgaactcctggcttcaagcagtcttcctgccttagcctcctgagtagctgggattacaggcatgtgctaccctgcttggcttgttttaaaaatgcatttcaaggcagacgcggtggctcacgcctgtaatcccagcactttgggaggcggaggcgggcggatcatgaggtcaggagatcgagaccatcctggctaacatggtttccatgtcttgctcctggttttccttcgctctctgggatggcacagaaagttgtacatatttctgcagtacgtttcataaactgttcatgaaaaaagaaaaaaaaagttctacatattgtctgccatctctggaatagttgaacaggttagataggttctttgaagaacaacaatagaaaagtacttccaaacaaagtctgtctcaagtcttcagatgcacttcaattgtagtcacttaagacagatgttttttgatctctgtattaattgtcctattgtagcagaacaaattgtcccaaaacttgtgcagtgtaaaacaagacacattgattatctcgcagtttctgtgcgttgggagtctgggcgcagtgtagctctgggtctctcacgtggctgcagtcatctcggagcttgactaggaaggacccacttcctggctcactcccatggctgttggcagggtccagcgctttggaggcctgtttcttacgagctgctggccagcggccttcctcagttgcttgccatacagcctcttcctagagcagctcacaccatgtcacgtgacttcatcaaagtgagagagtgagaagacaagaaaagaaagagggccagcaagagcaagagggccagcaggatggtagacagtttctcatggcctgaccacagaggtgacaatccatcacttgccatattctctttattacaagtgagtcactggacccaccacatattcaagaggaaggaactgcacagaatgtgaataccaagtcacgggtttggggggaccattttaaaagcctggttaccagaatctcctgtccttttctgagcttgtgtagctagtgtcagagaggtggattgctggtttccttggttgttgaggaactgtggagaaatgtgtcggaagtgcccttagccatatggtaaaattcccggaagtagatatgctaataatttgtcagctattcccttgtgagacttttctagatctctcttccatccttcttcccctactcaaatggtgtcttagtcatttccagctgctataccaaattatcatagactactgggtgtcttaaaaaacagacatttatttctcataactctggaggctggaagtccccagagataagggtacgagcatggcctggttcttgatcagggccctgttcttgactatgttctcacatggtgaccaaagagatctcctgtctcttccttataagggcactaatcccatggggagggggggccctacctcatgacttcatcccaccaaattactccccaaaggcctctgcctccgcataccatcactctggggagcagggcttcagcagatgagttcggaggagacacaaacattcagtctgtagtagatggtatgatggcatttagtttcatttctctcacctttgtcttactacatttctttcttcctttctttttctttttctttttttttgagacggagttttgctcttgttgcccaggtggagtgcaatggtgtgatctcggcttaccgcaacctgtgcctcccgggttcaagccattctcctgcctcagcctcccgagtagctgcgattacaggcatgcaccaccgtgcctggctaatcttgtatttttagtagagacggggtttctccatgttggtcaggctggtctcaaactcccaacctcaggtgatccgcccacctcagcctcccaaagtgctgggattacaggcgtgagctaccacacccagcccctgctttctttctttctttttttttttttttttttgagatggagtcttgctttgtcgcccaggctggagtgcagtggcgtgatctcggctcagggcaacctccgcctcccaggttaagtgattctcctgcttcagcctcctgagtagctgggtttacaggcatgcagcaccacacccaattaatttttgtttttttagtaaatactgggtttcaccatgttggctaggctggtcttgaactcctggcctcaagtgatacacccacccccacctcccaaagtgctgggattacaggcatgagccactgtgcccagcctgtctaactacatttcaacacaataattcctcttcctctgtttcctccctgacctgcctccctcatcttggtctttgaattcttgctgacagttgctttctcctccttttgctctctggttgttttcatgggactctgccatgcctgcttagttctttaggtattatttttgaaaactgttcctttttagatttgacatcactgtgactcttctgtaagttccttgactgtatttctttttggatactgaaatagtttgagctgaactcagtgttctggtacagagaacaggatgctaaggtaaaattgtgtcctttgcttcccacagaaatttgaaaaagaaagcccataaaatgtttcaaacatgcagaaagtatacagaataatagaactgaatgctggtgtgctcactccctgggtgtattaagtgttaacatgacattttgttatctttgccacagatttgaaaagaatgtactcatttaaaagtttatttatgtgttcaaaatatattgatggacatgttggttatttacatatttttgctattgtaacaatgctatgtgagtgtttccctgtgctcataggcaagtttttgtagccatagataatctgtaacacaaacttctgggtgattgataagcaaaactgtaagtgataatcacttctgtaatatgttgacaaataaatgttgaagccactttcaataacatacatgaaagctttagttgaggaagaatgctttttgtgttggccatttagatggaaaaatgctaactcatgttacctttcatcttttgattataccagtatggcatgctgtttttcagaacatgctgtttgcatgcctataaggaaaactgatggaatattggaattagtagcaaaaattgctttcatatgataatttaaaaaatattcattatatactttatttttccttggtggtatcgttcaatcctatttaggagtcatcagccaaacctatatttattattctttgtaccatcctaatttctgagcaagatttttttaaagctttttattatggaaaattttaaacacacaaaactagagaagatagtactgtgaaccctatgtacacatcacccaacttcaatacaatcgacttttcttttgaggaaggctttaaactgcaatcttaacattagttttatatttagaaagtattacatccagcgtaacacaaaatattaataacatccatttgaagagttattttagtattcctgtgaggtaactggcaaatgtttagaggacttattattattattagacataaaagtcatccttttaatacagttttgcaaaattataggtatattgtggatttcttctctccattagtttttcaggccagtagtctatcaggccagtcttctctctgacagggagattgtccataagttttgtaaaagtgagacataagcccttcaaaatgttttgatacaagaagtcagaaaactatttcaaacatttagaggactttgtttttaaaatgatgttcagggaccaaccagtaatatcccctggtcactgcagtgtttgtgggattctggatcaaacactatagaagtcactgcatgagctgcatctcatgtgtttgtcgtgtgcttggattccagatcgcagtggtcatgggctcctgcaccgcaggaggagcctatgtgcctgccatggctgatgaaaacatcattgtacgcaagcagggtaccattttcttggcaggaccccccttggtaagaacataagaacgttggtcgatggaaattaagtatgcagaacataaaatacaccatttaaactattttttgatgttttaaaaaatattgtgataaaatatgcataacataaaacttactgttgtaaccgtttttcagtacagcttggtgacgtttagtatgttcatattgttgtgcaaccatcactaccatctatctcgagaacattttcatcctccccaactgaaattctccctatttccgtcacctctgccacctcggcaccaccattctactttctgtccttatgaatttgactattctaggtatctcacatgtcagtggaatcatataatatctgtccttttgtgatagacgtatttcacttagcaaaacgtcttcatggttcttctatattgtagcagatgtcagagtgcccttcagtgttaaggctaaataatgttccattgtatgtatacactgtattttgtttattcattcatccatcaatcgatatttgggttgcttccactctcaggctattatgaataatgctgctatgaacatgggtgtacaaatttctattcaagttcctgcttttatttttttgggtatatacctggaagtgaaattgttggatcatatggaattctatgtttactttttgaggaatcacttcattcctttttatggctgaataatattccattgtatggttatgctgtgttctagctatccattcatcagttgatgggcatttaggttgcttctgcttttgggtattatgaataacggcgctttgaatgtataggtttttgcatggaaatgtttttatttctgttggatatgtacctatgagtagaattgctggatcatgtggtagctgtgtttagcattttgaaaaacttctaatctatccaatacatgttttacatttctaccagcagcatgtgagggttctgattgttccacattcttgtcaacacttgtaattgtatgtttgtctgatgacagccatctttgggggtgtgaggtagtacctcattttggttttgatttgcatttccctagtgactagtgatgttgaggctttttttttttaactttttaatttttattttttattgaggcagagtctcacactgttgcccaggctggagtgcagtggtgtgatcttggctcactgcaacctccacctcccaggttcaagtgattctcctgcctcagcctcccaagtagctgggattacaggtgcacgccaccactcccggctaatttttgtatttttagtagagacagggtttcaccatgttggccaggctggttttgaactcctgacctcaggtggtatgcctgcctcagcctcccaaagtgctgggattacaggcatgagccactgcacctggccaaggcatcttttcatgtgcctgttggccatttgtatgtcttctttggagacatgtctattcagattctttctcatttttaaattgggctatttgtctttttatttagttgtaagaattctatatgtgttctgaatacaagtcccttattagatttgcaaatatttttgctcattctgtaggttgtcttttttactttcttagtgatgtcttcctttgaagcacaaaagttttaaattttgatcacatccagtttatgcattttttcctttggtttcttgtgcttttggtgtcttatccaagaagcctttgcctaacccaaggtcatgaagatttactcctctgttttcttctgagagtcttataattttagctcttgcatttgggtctgtgatccattttgagttagtttttgggtgtgggataaggaagggctccagcattgctctatatgtggatatgcagttgttccagcatcattagttgaaaggactctcctttccccattgaatggtcttggcagaaaaaaacttttacttattttttcttttacctcagctatacaattgtttgactcaaggtcaataacaagttaataagctgttaagagaaagcagcaagattcctacagtgtattaacttttgtgtaaaatggagagaaatatacatttgtatacttctatatgcataaagaagttctagaaaagatacgaaaatactgcttaaaatgtagaggagaggaaacagggtagaagaaagacctttgatttttttgaccctgagactgggtacagtggctaatgcctgtaatcccagcgctttgggaggccaaggtgggtggatcacttgagatcaggaactcgagaccagcctggccaacatagtgaaaccccatgtctcctgaaaatacagaaattagccaggcatggtggtgtgcacctgtaatcccagctactctggaggctgaggcaggggaattgctttactgggaggcggaggttgcagtgggttgagattgcgctactgcactccagcctgggcaacagagcgagactccatctcaaaaaaaaaaaagaaagaaagaaacagaaaaggacaaataaatgattttacttctatgaaatattgagaataggcaaattcatggaggcagaaagtagattagttgttgccagggactaggaggagggtggaatgggagtgaccgctaatgaggatggggtttcttctgggagtgatgaaattttctggaattgggtagtggtgatggttgcacactttgtgcactttgtgaatgtactaaaagccactgaattgtatgctttaaaatagtgaattttatggtatgtgaattctattccaaaaagtttgttgcttcaaaaatttgtccaagaatcatctttggttatggaatactaatacaaattcattagaaagaatatgttaaatagagcttatgttttgatgtaaaataagtatatttcccaaaagagggtgttaatttttaataacttttactgaagatcaggtaggcctgaagggctgccatttcaaatgtaaaagtcttaaggcattattttaaaagcctgcagccattattattattattattattattattactattattattttaatttatctcttgtatgtgatagctgtcatttgttaatgagaggaaaatgcactcaaaatttacctttgtatagtaaaaggtacaaactttcatgggccattcttgtttattttttgactagaaaatgagtaaagatatgactacaatttgaaaacatctttttggaaatacaggcagatcataatagtggaataatgcgaagggttttagagagaagattttgtctaagggtcagtagttacaatgtccattcagttaacttgtaccttataaagaagccacttggcagccagggaagcctgaagttctgttggagaactggaccccatccagcaatccacctttgaaagaccatgttcacagggagaaaaaggcagtagcagcagcctcatcctttagagaattctaaattctgacgcacgcttgaccgaatgttgagaaagggctttgaagggtttgcacgtagtgtggggtgtagtgctgtagcttttagtagcttagagtagttgaaaaaaacagatagtaagacaagtttttgaaggcgctttttgttctcctgtcttttgtttatcttttgaacttgtcatttagtcaaatgagctgttttaattttctctttgacttctatcatctttgcacctatcacactatcaaacgttgtgggtgttcaataaatattaactgatgacaaattcttatttttttttttggttgatattagtcagatccctgaaaataaatataatttatctgttgtttattcctttttgcaactttaaatatccagacacctcttataatttgttattgtctggactgaatgttattttacactaaatgttttggaaggaaaagaaccaagaatttagttctgggggtggaataattggaggtgaaaattttaactaactctctctgcagaaggatatttaagacaaagcttttgatgtagagagtaataagttgtttctatgctgtattttcttttcttttttctttttgtttcagggctcccctcaagaaagactttttctttaccttcaacctctctgtgctatattttagattaatgttcattattctaataaaagcttttcttatttgagttgattaatttgtttctttttcttcaaagaaataggaatcaataaataattcctaaggggttggattggcatttagccttaaattatttttctttctttttcctggtagaatttctctggctataattaagttattcttaatttattactggagtttgtttctttttggccacattctgctagatcttaggtttaggtaatcttggagatttttttcctacctctctttcctatgcagagtttgtgatagtaaatggaatttttcagcatgttattgagtattcaaagatgaataaatcacagttcctgccaccaaggaattcacagcatagaggagatgacagacataacatgcacattactgaactacattctgacacatgccgtgttggaggtgtaagtgcaatgcccttggaccgtggataggcaggcagtcctctattaataccatggagaaggcctgggcgggtcaggaaagctgtgtagaggaggcaacttgaggtgggacttgaagggtaagtgggaattcgtcaggtaggtgagaagaagagatcccaggcagtgggaggaacacacacacagacacaaagtcttgaccacatgtgtcagggcagcatgacatagggaaagaggatggcctttcaggtctttcttcttttttttttttttttttttgagacggagtctcgctctgtcgcccaggccggactgcagtggcgcaatctcggctcactgcaagctccgcttcccgggttcacgccattctcctgcctcagcctcccgagtagctgggactacaggcgcccgccaccgcgcccagctaattttttgtatttttagtagagacggggtttcaccttgttagccagcatggtctcgatctcctgacctcatgatccacccgcctcggcctcccaaagtgctgggattacaggcgtgagccaccgcgcccggccaggtctttcaagctggaaacgtgtgggctcaaatgagactccattgcttgctatggactgtaagcaagttctttgtgactctgggcttagatttttcacctgtaagagtaaagataatagtctccaggtttcctaggtgcatgaatgagaaagcacagtgttctttagttctatggaagaaaaagtacaggtatagtcaggtgaggagttgtgcatgttggggaagcatttttatatgtctgatggaccgatttcactgatgatttttatccttgttgtaggttaaagcggcaactggggaagaagtatctgctgaggatcttggaggtgctgatcttcattgcaggtgaaacagaaatggttgtttctttccgggattgagtgtcattttgtttgtttgtttaaaagaagttttacgtatttgtttccagtgctaaacttgccagaccacaccacagtttatttgttcttgatctgctggtttaatgttcaattctttgaactgtagagttgcatttccaagctagagcatcagccaagaaggactggagagacaggtttcttatttatttgacaaacattcattgggcacctgttatgtagcaggcactgttctgggtgcctgaggtaagaggtagatactatctttgacttcgaggaccttatattctagtcagggaggtgggcaattgcaagtaattgcacaaaattatgtaaatgtggctgatacgcgataaggcttacaaaggagaagagggaagagcatagaggaggtgggtctgccctggggtgtacagttaaatgtttagtaactggttctctggggaggaaaaaatgccccgatctgtggcatttgccaatttctgtggtatgagtgatcccaccatggctgatttcaggctgccaacatgatgcctctatgtggaatcagacacagatgcacgtagttggctcttgtgagttagctgtgagctggcttcgtcacattgttggcctgaccatgttaggttagagtgcaggggtaagaagaccctctacctcctagaatgttgtcagaagtcaatgagatacaatacatgtggattgctttagaatgaaactatacctgcttttgataagttagctataaatgttggttgccattatgattattttcttgtttgtcatcatagttgctcaataaaggttttagactttttttttttaggagtaattgggaaacaattgaggaggagggtttttttttcagttttatatatatatatatatatatatatatatatatatatatatttttattttttgtagaaacaggtgtctcactgtattgctcaggttggtttaaaactccttgcctcaagcagtcctcctgccttgcccttccgaagtgctgggattacaggagtgagccactgcacctggactaaatttttaagcagtttgactatttaaaaaaagtaaagctgtaggcaatatattatgttaagggtgtagattctggaatttaacttccgtttgcctcccctattccccttgggacttagacaaactgcttaccctatctgagtctcatttcctcatagataaagtgaaaattgtgaatagtgcctgcctcataacacagcatctactacatataacagtaataactctattactgttattcataataacctgtttaaaattgtgaggaaatgattgggggtgatgaatttttttttttggaaagtaccatgaaatttattagtcacaagtggctctgtgttctctcaaatgcatctttatacctctcttaagtcatccttaagagctaatttgacacaaagacttatatatacagtgtatcattgaaggttttcctttcctgctgttttggtaaatactagacagttttcataaaaaagcattttattttaaatatttactgatttagaagctgttccttctgcttctatttgacttctgacagtgtagttataagtcagcatttataactggtattatgtatgaagcatttaaaatatatggtcagtcataacatgataaaatgttgtattaaattaaagaaactgaaaaagatctaccatttgtgaggcatctgtgggctatgaaaaagagtaaacgtggtctctgcttttactcaggaactcccagtcctaaagtagagtgtcatgaaatcactgagagcctagctctaagatatgtctcccaaggagtttggtgttttcccaggcaagccataaaaatttagattgcagcagcttagtccttactcataaaatgaacaaattatttttttcaggtatgtatttttgactgactttacagagttttaaatactttattagaaagtcatagtttatctacatttatctactattgaaataacaggccatctaattgggacaggactaataaccagagcaagcccgtacttcattcactgcacttgaaattgaacaggaacttccatggcccctgccacagaaccgttttactagttccgatttttacccataatccaagggccaatgtattcaagccttttcatttgttgcctgtgatggcttactgtcagtgtaactttgtagggagggggctcagagttctctcagaaatgagaggccagaattggcatctccattaggagctcagttacgtacacagtttatgccgtaaccaactacatcatgaaagtgtgccgtctgtggttggccttcatcacacgcaattctgcttacggtacaggggatgagtacttaatagaagcctttgtcagcaaggccccttggtctagcagaggaaggttaaggttagaaaatagaaggcgggggttcttatgtagctacttgtggtcttaggtgaaggtacttaacttatgcgtacttcagcttttcctgtttgtaaaacaaagggaatacagttttgccagagttcttaaaaggactacttaagatgacatttattaaagatgacaaattttttaagtgttttagaagtaaaagtgctgtcatctttagatgagagaagatacttgggacctgagatatttaattattttccttttccctgttctgacaagtttagtttgcttattctgtagaaagtctggagtaagtgaccactgggctttggatgatcatcatgcccttcacttaactaggaaggttgtgaggaatctaaattatcagaagaaattggatgtgagtacgatatgttcttatatcttttattttcctgaaatgcattttgactcactgcaccttgaaatcatgtctttaaacaggttaacatgatctatatttctgcaggtcaccattgaaccttctgaagagcctttatttcctgctgatgaattgtatggaatagttggtgctaaccttaagaggagctttgatgtccgagaggtatgtgaaagtggaactgtgagctttatgaccagctgtgagtctctttgtatgtgtatctatttgcaaagctaaagtttgttaagatatgttcatgcctagaaatagatgtggatctcagtaaggagtgacatatgtggcaatgatacctttccatactgtggatatcattggcacagagtaaatactgaaagaggggagtgggggacctcaatgattggaaagttttcattgcgcaaaaagtgtgatttggtcataagtaagactccatgtcctgtgcacattatgaatgatgtaaggcaacttaacaattgtcagctatttcttttcattgttcttattttgggaaatgggtgaaatgtcagtaagttgttggaagaaaaaacatacccttttagatcaatatgacatttgcaatgattagacctgattacagttgaaaatgttgctatggttacacattgtcgacatagtgttctgtaatttagatggacaacttttagggtttagagcatatagtcttttattttgttcagtatccatagttggcagagtagtttttaaattaggaaattatcttaatatcaaattctgtactggaagttttaatatttcaaattatattttccccttgactataaaatattatatattagttgtgaaaaatatagaaaatacagaaaagaaaaaaattaaattgcatataattccaccctctagagaaggtggctaatatttggatgttttaggttaatgtgtatatacgcacatttttatgtagttgagatagtctatacgtatatttttttgttttactttttctagtttaaattataaacattttcccatgtctttagaaattcttcatgaaatattttctacggctagatcttaattcctataatagtacttggcaacatggtaagtagtcagtaactattttctgaatgcattgatggatataatgttctgttgtatggatttatttaggcaataccccagcattgctagtgggtcttaaatcctggattttattgagcttcaagtgatacttcactttagcaaacgtgacttagttaattgtaaatttttaaatgaggtttttagtttaacttttaattaattataagcacaggaaaaaatggtacttaaactctgacatacttgaaaaatgtgttgggccaggcgcagtggttcatgcctgtaatcccagcactttgggaagtggaggcaggcagatcccttgagtctaggagatcagctggctaacatggtgaaaccccatctctactaaacatacaaaaattagccgggcgtggtagcacatgcctgtaatcccagctactcgggaggccgaaacaagagaatcgcttgaacctgggagcagaggttgcagtgaaccgagattgcactactgcactccagcctgggtgacagagtgagactctgtctcaaataaataaataaataaataaagataaaaataaacaaataaataaaagagaaaaatgagttgttccaggtagccaagttctctggttggctgagaattcaccctttttcgtgtaaccactgcaaccactgcttcccaggttcaagcgattctcctgcctcagcctcccgagtagctgggattacaggcacccgccaccatacctggctaatttttgtatttttagtagaggcggggtttcaccatgttggtctggcttttctcgaactcctgaccttaggtgatccgcccacctcagccttccgaagtgctgggattacagatgtgagccaccacacctggccaattaatacattcttttaaaaaaaatgtattaaagttatagcttttaagttcagcttaaagatacattattctatgtataagtctaggaaattttaacatttccccccttcttcctaagaaattttcaaatatgctgagatgttcaaagaataatacaatgatcacctgtatatgaacctcatagagtcaacaattgttagaacttgtgtcatttgtgtgtgaaatacattttaaagcacaggcacacctcagatacattgtgggttcagttccagatcactgcaataaagttaatatcacaataaagtgagtcacatgaactttttggttttccagagcatataaaagttatatttatactatattgtagtctgttcagtgtgcaggagcaccttgcctttaaaaagtacatacattaatttaaaaataccttattgcttttaaaaatgctaacaatcatctgaaccttcagtgaatcatcttttgctggtggagggtcttgccttgatgctaatgacagccaactaatcagggtagaggttgctgaaggttggggtggctgtggcaatttcttaaaagaagacaacaatgaagtctgccacactgactgactcttgcttttatgaaatattctctgtagtatgcaatactgtttgctagcatttgatccagggtagaactttgttttttttcagactgagtctcactctgtcacccaggctggagtgcagtggcgcgatctcagctcactgcaagctcagcctcctgggttcatgccattctcctgcctcctgagtagcagggactacaggtgcccgccactgcgcctggctaattttttgtatttttagtagagacggggtttcaccgtattagccaggatagtcttgatctccggacttcatgatctgcccgcctcggcctcccaaagtgctgggattacaggcatcacccaccgcgcctggcccagggtagaactttcaaaatgagtcagtcctctcaaacctgactactgctttattaactaaatttatgtaatactctatatccgtaattgtcatttcacagtgtttgtagcatcttcaccaggagtacattctatctcaagaaacttctttttttgctcattcataagaagcagctcctcatctgttcaagtttgaacatgaaattgcagcagttcagttacatcttcagactccacttctaactctagttatctccaccacatctgaagtgacttcatccattgaaatcttgaacccctcaaagttacccatgagggttggaatcaacttcttccagtatctttaatttaattaaatatccttaatgttgatattttgacctcctcgcatgaatcgtgaatattctcaatggcatctagaatggtgaatcctttccaaaaggttttcgatttactttgcccagatctgtcagaggaatcactatctatggcagctatagcctgaggaaatgtatttctttttttttgagacggagtctcgctctgtcgcccaggctggaatgcagtggcgcaatcttggctcactgcaacctctatcttccaggttcaagcaattctcctgcctcagcctcccaagtagctgggattacaggtgcatgccaccattcccagctaatttttgtatttttagtagagacagggttttaccatattggtcaggctggtcttgaactcctgacctcaggtgatccacccgtcttggcctcccaaagtgctgagaatacaggtgtgagccaccacgcccggcccaggaaatgtatttcttaaataataagacttaaaagtaaaaatgactccttgctccgtgggctacagagtggatgttataacagcaggcatgaaaagaacactcatctctttgtgcatctctatcagagtcttgagtgaccaggtatattgttagtgagcagtaatattttgaaagaaatctttttttctgagtagtaggtctcaacagtggccttaaaaattcattaaaccatgccacaaatacgtatgctgtcatccagggtttgctgttacatttatagagcacaggcagagtagatttaggataattctgcaacttaaagtcaccagctgcattagcctttaacgagagagtaagcctgtcctcagacgacgtgcactaacctctccccagctatgaaagtcctaggtggcatcttcttccaccagaaggctgtttcatctacactgaaaatctgttgtttaatgtagccaccttcatcaatgatcttagctagatcttctggataacttgctgtagcttctataatacatcagcacttgctgcctcaccttatacttttgtggtacaaatggcttttttttttttaaacctcatgaaccaatctctgctagcttcaaatttttcttctgcgacttcacctatccaagccttcagggaactgaagagagttaagaccttgctctggattaaagggaatgttgtgcctggcttgattttctatccagactactcaaaccttctccatatcagcaacaaggctgtttttgctttctcgacattatggattttttgtgaagataagtgaatgtattttatgtggcctggtggtgttaattgtaatgcaaatacaacatagtttttcactaaatggtcctaaattgctgtgccctttgagcagccgtatctctgtgtggaagaatgatagttgttacgtgttgattgcttgttaaaggtacaatttttacaggtatatagcacccaaaacagataactgttacattcccattgtattattggattttttaggaaaagaagtaaaaaataattcagagtaaacttttacttgatggtgagaaagatgttgggaagcattcactcagttttcagcctttgcatcatacaaaacaagattttgattgatgtggcagacagaaaaagcgaagtgcaaactatgtagaaaaatagtatgtatcatctaaaatagtttctgaaattgaaaatatgcttcctgtttagaactccttacagtagtcctgatatataatgataagccccagggataaactatttagtaatttccactcctttatacatatgtggatgatccttcaagtataccagattcagaatcaatgagtctttattaagtgcttaataatagtgatagctacactttaatgagagcctgacagtatgctttagttagcactttatttttattttttacttttttatttttcttttttctaccctgttaactgatagtgctgtttatccttttatttttttttctaatttattatttcttgctgaaaggaatagttagcactttttacatttttttttttttttttttttaacagatgaggaaactgaagcttaaagaattttctagtttctcagtcggagagctgggagtcagagctggcttttcatgtcagcatgatttttgtaggttcctacttccttacaagtagatcatatcttcacagctcttctgttccatcattccagaagtgagaactgagactcagaggggtgaagtgacttactccagggcataccagtcatacttgataccttagattggagcctgtgtcttttgactctgagccctgtctctacccagctttctcattgcatccctgaacctctgccggtacattcgaacagtccttgaagctctaagtctagcaaccagcccttggagcctttcctgcttttcttgcatgcagcatggtgctgttgcttgtatagtgaagtataaaatcagaacccagaatgacttcagggcattaaccaggcatgtcaaatgaaattctagtgagattttctgtgtagtgtgaaattttgtgaaagtgacaacttcactgtgaattgttttcctataagtaactttaatacaaaaattcttttgcaatataatttctcaaggccattgttgtttttcctcttaggtcattgctagaatcgtggatggaagcagattcactgagttcaaagccttttatggagacacattagttacaggtataaaggtgaagaattgaaaatacgaacattttctgctgctttgaaaatcaggaatctcttgtttcaagactttgatacacttgacatgggctttgttgttgagagcactacaaatgtgtgagccacttttaaaaggaactgctttataaacataatttgtagcttaatggcttcatggatccaaatagtttaaaatgttaatagctagatgctgtggtgtgggtccctatctgtgactttgtgacattagttgtataaaaaggttcttatagtaaaattagtagaaaatacttgtagttctttttgtttttctggataacaataattattttgaaagtttcagcactgtttcctttgttctttactgtccaattcaacgaggaagttttatattgtgtttagcttcccagaaggatatagagtgagttaaaccttctcacagcctctgtgtaggtcttaagctgattcatgcagacactagattgagaattcagtatatcacgtcaggaaaaacaaaataaggatgtttataaaagttaattttttaaatctaaactgtttagtttataggcctttgaagaagagtttttgagatagatgctagacccataataatctatttgggacaaatggaagaacaaattttgtgaattttacttgttcataaaaaacttgaaaatatagtagttagtcaaaggtaataccagagtaggaaaaaaactagctgcagaaatccaaattgcaaatatacattgaggcttaaggataaatcacagtactttgtcctagtttgatttgtgaacaaaagaagggttcacactgggagtagaatttatgtttttgtacttaggtgtttaagtgattaaaagctttttgtttgatatatagacaggatttgtcaccaaattgttcagaatgtaacagtcattgtgtagcagtttaaaacaagtcaaagccatttctgctttctgtaaagatggatgggctgtctttgtcatctgcttttatggatttgcctcctacttgctaaaagccctgtggcactcttatcccctagagtacacaacctggtttcttccatctcttgactgtactggagttcaaatacatttagggacagagaaggggagtgagaaggagaagaagggaatgagaggctggtggtgggagttgggggtgggggtggcggataagaaggatgggaggaatgagaaggtgggaggcataaagggtgaggaggtgagagggaaggacagatttttctggttctcaaatgtctctggaagttcctcagggtttcctcctgcctcagcacttaccatgtgtagcctctagtcgtttcttggacactgtgctttcccgtttgtaactcaggtttgatcaggcagttggtgaagaccgtccctctatgggtgtccctagtagtgtggggacatgttccctactcagcgcatcctgtctgtgcctggagatccctaagtggggcctagtgtgggttgaatctaagtagttaacagggttgcgcatttgcaggggcagcatctttccagtgagtgatgtgttaaattcccatgtctttgtgcagtgaagcaggactaagaatggatttctggactttttggaagtttacccctttctgaattgcttctgtaagtggcagtgccatttaggatgtactgcataagtttttggctgggattttaggactgaaatacatgtaggtggccatcaaatcagggtttcattgtatcacattaaataaacatgataagttagccaggtgtagtgactactggggcctatagtcccagctgcttgggaggccaaggtgggaggatcacttgagcccgggaggttgaggctgcagtgagccatgatctcgccattgcattccagcctgggcgacagaaaaagaccctgtctcataaatagataaataagaacatgatgatttttaaaaagtcataaacccagacaaagccagagtaaagaagaaaaaaaaaacaaatctttaaagattcaggctgggcgtggtggctcatgcctataatcccagtactttgggaggccaaggtgggaggatcacttgagcccaggagttccagaccagcctggcaacatagcgaaaccccatctctacaaaaaatacaaaaactagctgggtgtgggggtgagtgtctgtagtctcagctactcaggaggctgaggtaagagggaggatcacttgaagcctgagaatttgaggctgcagtgagccatgactgtgctactgtgttccagcctaggcaacagagtgagaccttgtctcaaaaaaaaattcagttttctggcttatcagtatgttgatactctctcttatctgttaatttttcttcaataattattttgatattaaaaatgatatttttatagtatccctagtgtctggtacatactagacactcagatatattaaatgaataaatggataatacactaagccaattatttaatcaaatcaatcaagacaaatggataactctacatgtatcgtgaccctttctagaagcaaaagaaaccagagtctaggaccttaggaacaagaagattgtgacatgagctgttttataccatagacaaaatctctttgcattttaaacttggatctgatattaaagaatgtgtaaatatgcctctttcttgtgaattgaagcccttggaaaagcacaagacataaatcttctttgaactttcttttgaggatttgctcgaatatttgggtacccagtaggtatcgttggaaacaacggagttctcttttctgaatctgcaaaaaaggcaagtactgttaaaaatatttcaagattttctgttttaatttaacataacgttgaaggtcaaataatgagttaaaatttattgcataaaaatgcttaactagatgcctcagcaaccagaacactgtgtgcgcgggcatgtgtgtgtgtgtgtgtgtgtgtgtgtgtgtgtgtgtgcgcgcgtgtgtatatatgtgcatgtatgttagtatttgaaacagtttttatggtggtttacattaacatgctgtgacgaaccatctggagcactattaaaaatgtactcattttaggaaaattctcctaagatacttgagttataattgctatagaggacatgtacatattctcagttgatagagaatacttgtcctgaaagtgcttcatgtcctggagggactcagaggtctcatggttcaaagattcaggtggttctgagacatgatctgtttattctcttctatcccattatcgctttaactttattgtatttttactttttggaaatgagaatagtgggtctttgttactggacccgtgactttaaaaaaggaagttctttttatttattattattattatttaattcaatcctccaagacatcagaaaaaagagggagttcttgaatatcttttggcttagttattatttgatttcatatatcatctcagatttacctaaacttggataaatgtaattcatatacttatttgataaaaatgtcttttaaaaaaattttaattcaccaaactacttcaggaaataaaatgtttccttaagaaaaaatatgtttagtattgctttttctcttgaaataacagggtaaaagttctctttattgatgcaggtaataggcagttaagctctttcataccctaattgaggaagaatttgtctttggtgaaattttttatcaataaaattggtttctgtattctgctacttattattactccttcaacttgattataaaatgagaacaagaaattaaaagtaacaaaaataaaaaatcacttataattataccagaaatagcttttagtaacattttattattttttcttaatagtttcctttttttaaaaaattgatatgctatatatagagaggttttgcatgttttcatttaatagtatatagacagtatttctcaaaatattagatattcctgaaataatgacttttaatgaatatataatatacttatttcaatagaggaaatgtcagagtgagtccaaacaaactctgcctggctttatttgtcagcttggtacaaataaaccccagaggagttatgtttggcctcagcctgacgtttcatttgttgaaataagccccaaaggtctatgtgattttctcattcttgtaaacgtagtcatattgaagtcgagcaattactttgcaattttgtacctgacaaggcatttccagcagaagtaaagagaaattcagatagactaaaacataaaggaaatggtttataagagtttcctaactcatacaatctttagggaagaaatagttgtatttttgtatcattaaataatttcctaaactcaaggttagaagatttctatcactcatctaatctaaaatcccatttatctggggaatgttggcaaggatgatatatttactataatcctgatgcattaaagaatttcagatgatcatcaaaatggaaatgtcatcttcatatcccaggagggtttatattctggcttttctaaagtggagagctagagaattatcatatagcagagttcagcaattctcattcgcatcagttctttcttttctgttacttaagtttcacttgctgtttacagtgttagtgattgacctcatccttgacgcaacaatagtcttagagccatgtgccagtgattatacaggtgattgtgcaaaactagtgtagtacaaacctacagttacatatcctattgataatggagtagcactgtactattactgttactctttctataaggtaagactagccaaacaaagggtattcttagccaggagtggtagcacacacctgtagttccagctactcaggaggctgagacaggaggattgcttgagcccaggagtttgaggctgcagtgagctataattgtgccactgtactccagcctgggcaacagagtgagaccatgtttctttaaaaaaaaaaaattaataagaagagaaaaaattttaaaggggagtattctttcttgtctttggctgaagttgtggtgtttgtagaatgcatgatgataatagagttaattcccttttaaaaagatttttatgttatttgcttatagggtactcactttgtccagttatgctgccaaagaaatattcctctgctgttccttcaaaacattactggtaagaaaatagcttaatcagtttggttgtattgattccagagctgtaccatcagtgtggctcatgtattggacagcacacatgtagaccacttcatcagagcaggaagttctactggacatgctctttctggaggccctttaagagttagcacttttcttcatgcatgttaaatattctgaggagattatccatattttctttcccccaagtagctgggcctacaggcatgtgccaccatgcctggttaatttttgtatttttgtaagacgtagtttcacccagaccatgttgcccagactggcctcaaactcctgagctcaagcaatctgcccgccttgttctcccaaagtgctgatactacagacatgagccacgagccaccacaccttgctgattatccatattttctaagtgaagctatttctgagttatgtacctgatcagcattcacatggccaccctttactcctgtgtgtgcacagccacacacccagaaagcagcaggagcatgatctgatcactgcagagagcatcatgcttttcctaggacccttttcctcctcaagatttcaggcacgtgctacggtcttcccttttattgtacagttaattcaacttaagtaacatcattttaaaatgtatgtgtataccctgaaccaaagtctggggatttgagttttggccccaaagaatggtatgaccaaagtgagatatgtcacctctctggactttactccagagatgaccttaacatggtggataaattgatttttaaggtctgttacggttgaagagtgaattctctgattctctggtatccttcattatatgttgcagagtgtctgagatatacagggcactcagatatgttggttagcagaaaacagcctcccccatcccaggctacctcagcttcaaaggaaggagaggctcttagtacttgttgggatcatgcaagcctctttgagaaggaagagtcaggctcttggcagtcaacagggcttgaaatagtactggtgctaaagcatcttcatcctgtgagctacttaggttcatgatatttggttagatgaatgttgagagaagttatatccaaatggcagcctaagagggtcctgcatggtaacttatgtaaaagggcagatagaaaggattctgaagcctaactataccagagttcttgtttttaataatgattcctggattgttaaccaccaggcagttaaaactctgtggtttgaagatatctacatttttgttttgttttgttttggccctgttgggttgagtttagtttttcagcattgcatttgaggttcctgtgggatattcacctggaggcatatagtgggcaggtgaataagtctcagcacaggagaggtgttttaggtagagatgcaaatgtagacatcatcagaatatggaggtaattttaaagctgtgggaatagataagaacccccctgagagaagagaagaaggttcagtgacagtcttcgagtacctctgattttttcctttttcttcaagagtaaaggaagatggggagcatgattatgcagttttcttaagattggaagaagaaggatttgagaaagcgaagtgagatgcctcactcttctttttgaaggcaggatcccctccagagaatagagggatggtgggtcgggttgggtggggtgagaacttgaagacagctgatatttgaagtaggtatggtgggaatgttacaatggagtcaaggctggggagattgaggagtttctgagcttttctgagggtccagctgagtaggatagctgcaggaagcagatggtgccaagtaaagggctgtgctgccattcctgtggtgactgcagaaggcacacgtgctctggaggaactggttgggttgaattggatgaccagatactggagtttggcaaaccagggatagtggcagtcaatgaggcaggtgagtctgcaggcccacagatggaagaaatgcctttgctggagacttgcggggtaaggagacaagcgaagcccaactcagtgttataaggcagagaaagaggaacccaagttctggaaggcagtgaagttgcagagcagcctccacagagctaggggcttgaagaaatagaaggatcctctattgaaatggaaaaatagtttttttttaaccttgctattgagtcactggcagggactgttagcatctctatgaaacattcatctttatgtcttcaaagtttcaaagcatcactttagaaagaacagtctgttttaaaaccaggtcagtgaaagctaaagccctcatagttaggctcatcacagcactttgtccttaactagccatgtcacattcttttcagcatcaagctgcttctttgacatcatctcctttttaaaatttttatttatttatttttaaatagaggtagggtctcgctttgttgcccaggctggtctcaaacacctggcctcaactgatcctcccgcttaggcttcccaaattgttggtattatgggggtgagtcactgcacccagccaagatcatctcttgaagatagattgcatcctcatattgtttgaaggtttctgtgtgcatccagatgaactgctttaagaaaatttagaaagtgattagagaaaattttattttatccttttaaagcaaactttttaacggtatgtttcacatataaacattttcttaaggcgagaggcatttagtaagatgagtttagtaaaacaagatgtccttttggtggaattgcgttccgcatattaatcccatcacccagaggctctctttctgatctttctctcaggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatataggtaggtgtcatgattttctctgaaacaaagaaacatgcttcaagtataaaatacatggtcagtttatttcaggtgtatttgaaatatagaatgccattcccagatctcaatcaattataccgtaatttgtatcatttggaggggtgaaatgaaatttaatgccaaaggtgttatttggaagaaatctacaatgggagtcaagaaatacttgaaatggctgataatgaaaatgccacacattaagatttgtgcagtgcagctaaagtctggctctgagaaaggtatgtagccttaaaggcatatacgggaaaagaagcaagactgcaagtcagtgagctaagccttcatctgtgggaagttcaaagaacagcacgttaaacccgtgacaaatagaaaggacataatgaagagcagacatcagatagaagaatcagtatagcccaaagttgtttggtttgaaagttcaacaaacttgataatcttatgcttaaactaaaaaataaagagagacagcacatataaccactatcaggaatggaaaaaaggacatgactgtagatcatgagaggatattatgaacgcttttatacccagaattacatggagaacttagaagtcccatctgtgctcaggaccctcctctggagtctagtctggggtgtgttccaggcatttgtatatttgtgaaagctctacagatgattgtaatgtgcagccagaatcaggaaccactaatttaaaaggcaaacatgggcctctgaaaatctatgttgtatattgacttaatttgtttattcttccttttcttcccccagcccaagatttctctacatttggccaaatgctcgtatctcagtgatgggaggagagcaggcagccaatgtgttggccacgataacaaaggaccaaagagcccgggaaggaaagcaggtcggtgtcgttttctcttgtttctctctggttttgcctctcaccataaacaccctggagccaaggagcagcgtgcctggaagcccttggtgttcatggctggggacctggcgcacactgcctggccatatttagactgtgctgccctggaagttgttccagcaaatcacatgatttctgtcctttatctttttaaagccatttcatttggggtactttctttgtggccatttaaaattgtttcagaatttccaagaaaacacttttttattttatttttatttatttttaaaatttttgagacagagtctcgctctgtcacccaggctggagtggagtgccgcaatctcggttcactgcagcctccacctcctgggttcaagcaattctcatgcctcagcttcctgagaagctgggattacaggtgtgtgccaccacgccaggctaatttttgtatttttatttatttatttatttatttttgagacagagtctcgctttgtcgcccaggctggtgtgcagtggcacgatctcggctcactgcaagctccgcctcccaggttcacgccattcttctgcctcagcctcccgagtagctgggactacaggtgcccattaccatgcctggctaatttttttgtatttttagtagagatggggtttcactgtgttagccaggatggtctcgatctcctgcccttgtgatccactcgccttggcctcccaaagtgctgggattataggcttgagccaccgcgcccggcctaatttttgtatttttagtagagacagggtttcactatgttggccaggctgctctcaaactcctgacctcaagtgatctgcccacctcccaaagtgctgggattacaggtgtgtgccaccatgcccagccaagaaaacactttagaaactgacagtaagtatctgaggcataaagatgtttgattcttagtcatttgtacttagtgagatttaaataagtctgatgtactactttgattttatgaccaaaagcagcagaattttgttctttctattttacttttagattgttgttaaggataccctgagtgggagggctccgtcatctattgagaattgaataacattatcctgtgtataaatgaagaaaaatggaaagggcagtggaaacttgatgaaaggcagatcagcaagcggctgcttttaaaatgaattcttttgtttgtgtctctgttggagattgtttgaaattttgcattaatttttattagttacaacttttaactcctgtgtaagcaccaagtatgaagatgatggttgtgtgttcctgaagttgcttaggtacactgttgtctcattatgggaagggatggaatggagggagccctgtctgctctgtgcaggaatcatcaggtcttccacctagattgtggagtgaggtactgcctccctgaatgcatccatccatgcctcacatccctagttgtcttttccaagcactcggaactctggagacttacattgaggtttcagattcactttagtacctactagtatcaaaggaaacagatagctttgcttttgtgcgagtggttggggtgtgggtgtgtgggtgggggaggtgagatatgaaattctacctgatacttcaaagacatgtctgaaactctatgaagcctagcatggtgatctcttattaagtagttgttctttgattacttcaatatacagatacttgaattcattcatttttatacaggaaaggaaagcacagtgtgttaatggttctccctcagaattcgtgacctagaaaatgatattaaggtattagcatatttacgtaaaagaaggtagagtttatttgaaataagtctttgtttctgctgtcgagttgctttttgagttgaaagtatttttcagggtttcaaattaagttctgaagatttttacatctgaattaattatcacttgatccttgtaatactgatgggaaggctgtgaaattcttaattaggggaaaatatctctcagttctctgggaacttgactgaaaaggttattcaagatttggttggtattttacccctttaagcttaaacatttaagcttaagttttaaattttggctattttaaatgagaatctcatacttttccacattcttaactggaggttgctaagtgtaatgcagcccttttgttgggttgtataattcacatctattattgtaccttgctgtgatacacagtaccctgggctttcaccttacgtgaaatagcctcaggatattgtctctgttaggagagatgggatggggcactaacttgatactcatgtcttagcgtgtatgttaatgatcacttgtaatttatacatcactatgcacatgttagatgtaacattattattcatgacatctgttgtttcttttgaattgagatgatctaaacagggccagttgttcactgaagctgacttactcatggcctcttttcctttagttctccagtgctgatgaagcggctttaaaagagcccatcattaagaagtttgaagaggaaggaaacccttactattccagcgcaaggtgggggccagaacatcactaactctctgatgggtgcagatggcagtcagaggaacagctttacagagctctgtgtagttgagatggtccagcattcataggaactggaaaataacatttggacacacttaattttgtactgttgtttctttacaatctgaatggctactgctgaaatgccacccctcctcccagcatccctgcactgtggactcaccaccagtggtctgattctcgcttcccttgtcttccccctagttgaggtgtctggggcctggaggggtcctgcagcccaaggtgggccatgttaggagccgagaataagttataagcttggctgtgttacttcagaagttctaatttttgcttaaaaacccctctccttgatcattttgtttttaccccattttaaacatgagattggttgaacacttactggcatttgttgacaagtatgcttgtacgtttgaaaggtgattagtcactgccagggtctgtgtgtcggcgccaaataattacctcacagaccattgccgctgttggctcggtttttttcttacaccacttaatgaggtaataaattatcatgcctgtcccagctgaagacctgctggtgcctgctttcacatctttcttcaacaactttagtgttctgcattccgaagactaatctaagcttcatgtcttcctttcatcccttgggcagatggaaaaaagaaagtaactctttctgcatcttgtaaaattagcttatgttgtaatttatgctggcgaaggcaaactggagaggagaggggagagaaaagaaaatcaggccaggcacagtggctcacacttataatcccagcattttgagaggccagggcgggcagattgcttgagcccaggagttcgaaactagcggggcaacatggtgagacccagtctctacaaaaaatatacaaaaattagccaggcgtgatggtgtgcacctgtagtcccagctactcagaaggctgaggcaagcagatcagttgaacctgggaggtcaaggctgcagtgagccgagatcatgccactgtgctccaacctgggtgacagaacaaggccctatctcaaaaaaaaaaaaaaaaagcaaaagttagagtccattacaatcatttgaatggttccttggtggatacaaagacaaaacatactgattttcaagaacataattagtttgaggagataaataataccatttgggtgtgtgtatgtgtttttgtttttgttttctttaaagacagagtctcactctgttgcccagtttggagtgcagtgacgtgatctcagctcactgcaatctctgcctcccggactcaagcaatcctcttgcgtcggcctccaaagctgggactacagacatgtgccaccacacctggctaatttttttgtattttttgtagagatggggtttcaccatgttggccaggctggtcttgaatgcctgagctcaagtgatcctgcctcggcctcccaaagtgcttggattacaggcgtgagccacctgtaatcgtggctggccaatatttgggaatttttaaaggttttttgctgaatatatatttttacaaacaaatttacaggtatattttattgtggtggtttgattcatttaattaagaacaaaatattttatagtctttgagagctaaacatgttcctgattttatcatcgtgtaaacagacatatagtagccagtaaatggaaagaagcaatagaaagccgtataagaggtttgagatgaaatataaaatatatattgttaagcttttctatagttttttttttccacataagattttgactgaaatacacagggacagctgaaatattaaagtttgaaaaattgtgtattttgtgtgagctgttagcttgtttttcagccctggctaagataaatcatctcttgagaaagattgcatcttttattattttcatactaacattattattattttttaatggattacattcaaggcagaagagtaaatggcccagagagacttatctttggaaataaatgttaacagacagtaaagttttctgtggatctgtagattttttttttttttttttgagacagagtttcttgttgcccaggctggagtgcaatggcatgatctcggctcactgcaacttccgcctcctgggttcaagggattctcctgcctcagcctcccgagtagctgggattacaggcgtgtgccaccacgcctggctaattttgtatttttaatagagatggggtttctccatgttggtcaggcttgtctcgaactcccaacctcaggtgatccacccgcctcggcttcccaaagtactgggattacaggcatgagccactgcacctggccagatctgtagatgtttaacccttctgttgaaacagctggtggcatggagacagcagctttctttcaaagctgaaaggatttccaagccagtttatggtaccttccttgggtttagtaaatctcagcttcacagtaaaattccctggcctgcttaggtttgaacatggctagatctgtcttttcagagacagagcttgttattatcagttactgaaacctacaatgttttccttaatcctaataggttacatatgtagcgtgccaatttgcttctgctcagttgtttttataatcaaacttttatccggcatttcattagtgcctcttacctggggcagtctttttaatgaacattattaagcagccccttcatcaccatgcttgctgtgctgcaggcttcagagggagtgtaatcaattcacctggttgcagatgacaagagtggctttctttttattgggtgttgatactttagggtccctattatgaatgttttatgagcaaaggtttgattcatgtctgtcaatgtaagaatggtttaatagttgatgccaggttcagataccgaagggagtttatataaaaaaagcaaactgccacctactaataacctttaaaaagtaatatttctcagtcatttttcgttatacatttgaggttgtcaatgagaaggaaactaaaatttctacttaaaagtttcttctgcaagcagtttaaagttattgtttttcctattgtagcaaaaaataaagacctacatttgaaggtatctattttattaataaaatgtactgaagctggccgggtgtggtggctcacgcctgtaatcgcagcactttgggaggctgaggtgggcggatcacctgaggtcaggagttcaaaactggcctggccaacatggcgaaaccccgtctcttctacaaatacaaaaattagccaagtgtggtagcgcactcctgtaataccagctgctagggaggctgaggcaggagaattgcttgaacccagagggcggagattgcagtgaactgagatcgtgccactgcactgcactccagcctgggtgacagagcgagactccatctcaaaaataataataataataaataagataaaatgtactgaagcctattcaataattttcatagtttcttaagagtttggatgggggttggggaatatacattttccagtaaagtttgaggttattacctgggtatatgtggttctgcatattaatgacagaatacaccaacttggcttatatatttgtgtgggaagaaaaggaataggaaaatttttcctgaaataagtaaacgtattgtcaaattaggggttactttgagatctcttataaaagtagttccttaagccttaagcctgacatgacattctgtggtggcctgggatgaaggtcatatcatttttttccacgttttccccctctgtcttgaacgtagtttctgttgtgagattatggtacatggatgctaatcagtagatccatatattacctgaaggaaaacttccttggcatttctgcacatggagagtgtataaatggtagtttggtggtaaattcataactctttttttgttcttttgtcagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttc

SEQ ID NO: 37283 - DNA, 70072 bp, Homo sapiens; identical to SEQ ID NO: 37282

SEQ ID NO: 37284 - DNA, 10950 bp, Homo sapiens
ggccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgaggtaatggcaagtcggcccctccccgcgctcgaaggagggggttcggctttgggagggtctttggggtctttggtcgagcccggacctctggtcggcccctcctacagtgataggacaggagggcgggaactcacgggttctggggacgatattccgctgctggacagctctttaaatgacgtttagtgaaatgtgtgctcctggatagtacattccccttccgtggctgtgctctgctccgtgggttcactcagcatacatctagttcttgcgcgacggcctaaaactttaactgccatgtgttctatgtagtataggcgcgcagtaatttaattccaagagttcaaggaactactaagtgggtcttcctcgtccatcccttctgctcctcaaagtagtactgctaacaatactttacgtagacttccacaaactgtctttgcctccacaagtgtgtgtgtttatctgtgtgtatagatagagtgttatagttcttcctaatctctgtttttcaagggagttttttaaccctccctcctcccaaacccttccccaatttcaagtactttctaaaggtttatgaaattttggacgtgtgtgatagctgtgctcaatttccagattcattcctgttttctctgagcctcaattttctacatctctaaaatagaattcatgcctgccataccagcttcatgatattgtgagggttaaatgcagtaactttgtgacagctctcaaataaaaagaattatcctaattttcaggataagttctagtttcatatgtagtgcctgaattgaatgtattatcccagaagtgatctaatcagagctaagtacagcagggctatttatttttgtaacttggatattgtttccattactgcatccattcgcttttttgctgtcaaagcgtgtttcagagcatggtaatttagcatagaaatatgcagaattaagactgccctaattgcaggaaactatctaactatctaaaccgtatgtttgttcaggcaaagcactgtacctcacgcctgtaatcccagcactttgggaagctgaggcgggcggatcacttgaggtctggagttggagaccagcctggccaacatggtgaaaccacgtctctacgaaaaattcaaacattagctgggtgtggtggtgcacgcttgtagtctcagccactcggaaggctcaggcgggagaatcgcttgaacctgggaggtggaggtagcagtgagccgagatcacgccactgcactccagcctgggcaacagagggagactctgtctcaaaaaaaaaaaaaagtttgttcataagtcagttaaaatgatgattaagttgacttgatagcccccctaaaatttaatttattgtatagttgaattttagtactagcctgagttcttatagcctatgtatgtggtcatgtgaggaggaggaaatagatatttattaaatgcccactgactgccagatgctttactgaattccttactttagccctagaacgaaggaaaccaaggctcacaaagagcaatgacttatccaaagtctcaaagcagtaaatggcagatctgggcttcaaaccaagggctttctgactctgagaccctttcttttcctttataccattgtatagctgatcttaggcaaaatttaaaaacaaaagcctgcttttatgccaggtcccttctgtacttgtctctctcatgccggtgtactctgcttacccccatcaagtacccgaggaatcagtgaccgcatcttcctttaaactctactgcaacactttctaagggctctgtgtgccaaaatttcttacctttcctattcaaaactgtttatgagagtaatgaatatctggaatgagaagaaatctgattgaaggaattcattcaaacatacagcttaaccccaacccaaattaatattgaattgtttgaattctacacagaaaaatgaagttgaaaaaaatgcagatagtagggcacggattgcttttattggaaagctgacatggatcaaatccttaaggatttattgttcttcatcccttcattccttcttgtttttgagttcacagttctattaaagttccaggttgttcccttgtttattccaacctggaatgttcttcccccttccctttcaactaattatattggtcactaaccaccacttcccctacaccaattaaatcctgtttccttggatgtgatgggatattcctgtgtgctttaatgtcttttttttttttaaacttttcttttggcacttatagtcagtatcagagtatcctccagaatattttctatgtattaatcttgcctttaatacatctataagggtcagggctgaattgtattcctctccattcttcttaatgcttattcaatgcaattaattaactcaaaattagatctttctggatcatcagagacccagtactgaatcctccattcatcaatcaacaaataattatctagcacagagataagcaaactttttttttttttgagacaggtttctttgttttttttgagacaggttctcactctgttgcccaggctggagtgtagtggtgtgaatacccctcactacagcctcagtctcctggactcaagcgatcctcttatctcagccacctgagtagctgggactacaggcatgtgccaccacacctggctaatttttgtattttttgtagagacagggtctcactaggttgcccaggctggtcttgaactcctggcctcaagcgatccccccatgttggcctcccaaagtgttgggattataggcatgagccaccatgcctggcccaaacattttcattaaaagactagatagtaaatatagcaggttctgtggggtctgtctcataatattcttttctttctttctacaaccctgtaaaaacttaaaaatcattctttgcttgagatgggccagacaaaaccagaccacaggcccaaatagtttacagatccctgatctaacactatgggttaactatgaaaaagtagaaagagaccatcaaagaaaaccagagctagtgagtagttgaagtggtacaaaaaccagatgttattcaggaactattacagtaggggaaaagagacttcagtatagacttccaaatttcctcagttccgaatatagcatggacaagtggagatttatagccaaggagcaaggtgggagtcagtggatggaaaattacccaaaggaaacatcaggggcaaggtgggattctggctaaattgacttgacaggattcttgctgaaggcatgccaggctgatcaaataccaagggtgggagttctttctaaactgattcagcaagattcttgctacaattgggtgggtagtgcaggcccaacaaagatgtcaaggtcagggcctagacagcttagaggaacctgactagaagtagataaaggagggcatcttgtcagtgcaaagaataataagacacttcctgccctcaaggaatgcagtccaaaattacaaaatttctttgattctaggtcatcaataatttttttcctgtgccagtcttctaaatcatagctttgccgggtgcggtggctcacacctggaatcccagcactttgggaggctgaggcgggtggattgcctgaggtcaggagttcgagaccagccaggccaacatagtgaaaccccatctctactaaaaaaaaaaaaaaaaaaaaaaaaattagctgggcgtggtggcgggtgcctgtaatcccagctactagggaggctgaggcaggagaatcacttgaacccgggaggtggaggttgcagtgaaccgagatcacaccattgcactccagccagggaaacgagtgaaattctgtctcgaatcaatgaatgaatgcaagcttctgggaaaaaagataaaacaatgccacatgaaagaaacacacaccaataggaaaacacattttaacttcagaaatgttaaagattatacattggtcttagaatcaagggaataaataatagacaccattttttgagcccttaacacatcacttagtcaactgtaagtaacacagaacaactaaaatagccttaagagataaggaccttttatattaacaagaagtcataaggtaggagggctccagagttcacgtggagactcatttgattccggctcttgtcatcttactgctgacacccttagtgtgccctacttgtcctccacctggtcctccaagtgcagaaactgcacttccacccttagcgtcctctagttgtcctctactagctctccactgggtctggcagaggccatagtagttccaggtatctaaacctcatgatgaagggaacgtctcttctgcagatttttaaagataaactcaagttttccagaagcccctccagcagatctcccctcacatttcattggccagagttgtgtcacatgccaatttttaaagcagtcattggcagaaggagtgggaaccaatcatggttcactcactgttcaattggggctggtgggtggctgtttattaggcaagccatagtatctgctacactgtgctaagcactttataattgttcagtctatgattttgcactatatacagatggttcccaacttacgatggtttgacttaggatttttttgactttaggatgatgcggaaacaatacaaagtcagtaggaacggtacttcaagtaggaacggtacttcaagtacccatacaaacattgtttttcactttaagtatagcattgaataaattatatgagatttaccacacgttactgtaaaatcagattttatgttacatgatttgcccaactgtaggctaatgtaagtgttcttttttattttttttatttttattttttttagacggagtctcgctctgtcacccaggctggagtgcagtggcgcgatctcggctcactgcaagctccacctcctgggttcacgccattctcctgcctcagcctcccgagtagctgggactacaggtgcctgccactacgcccggctaacttttagtatttttagtagagacggggtttcaccgtggtctcgatctcctgacctcgtgatccgcccgcctcggcctcccaaagtgctgggattacaggcgtgagccaccgcgcccggcctaatgtaagtgttctgagcacgtttaaggtaggctaggctaagctctgatgcttgataggtatattaaatgcattttttaattttaattttttatttgagtgctagaactaaatattaaatgcattttcatcttataatgggtttatcaggacataactccctcctgtattctgctgagggagtgtgaaaggaaaagatttggggtcctttttttttttgagatgtctcactctgtcatcaggctggagtgcagtggtgcgatctcggctcactgcaacctccgcctccgcctcccaggttcaagcgattctcctgcctcagcctccagagtagctgggactagaggcacgtgccaacacgcccagctactttttgtatttttagtagtgatggggtttcaccatgttggccaggatggtctcgatctcttgaccttgtgatccacctgccttggcctcccaaagtgctaggagtacaggcgtgagccacctcactcggctgggtcctttcgatttttagagacagtgtcttatgctggtacccaagctagagtgcagttctatgatcatagctcactgcagcctcgaactcctgggctcaaacgatcctcctgcctcagcctccctagtagctggaattacaggtgcaagctactgcgttcagctgatttaggccctaaagttggaattttggaagaaaaatttctgagattgctgtgatggacattttgctgatggaggtttcccctagacctatccatttgttgtctggatctgtttcactgtatactttcatagcaccttagaacccaaataaaagcaatttccttttcctccatgcatgttcccctcattgcctggagttgactggtaccacttggtaatcttactgtctgtgtctggctctctcttcagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatggtaagtatttaaaaggtaagtattacaggcctctctggaggaggtagccagcccatgggatgttcccagatttaaactaaaaccgtaaaagtgagacttatatttaaaaggtaaatctctttatttttaaagagatgcagcaggttttcatggatagggaattagcatttcaactttatcttcaagaccaacttcaaaattatcactggcattttttccttctctttctatcttttttctttttttttttttgagacagggtctcactctgttgcccaggctggagtgcagtggctcgatcacagctcactgcagcctcaacttcccaggctcaagccattctcccacctcagcctcctgagtagctgggactacaggcatgcaccaccatgcttggctcgttttttctatgttttgcagagatgcagtctcactatgttgcctaggctggtcttgaattcctgggctcaagccatcctcctgctgtggcctccccaagtgttcagtttacaggtttgagccactacgcctggccctgtcttttttcatttaaagaatgagaatatacttttcttccacttcaaaagctatcaagtgttctactacttaaacatttgtgaaaaagtgttgagccttcccttagaaaaatagaatgtggccaggtgtggtggctcacgcctgtaatcccagcactttgggaggccaaggcaggcggatcacctaaggtcgggagttccagaccagcctgaccaacatggtgaaaccccatctctactaaaaatacaaaaaattagccgggcatggtggcgagcgcctgtaatcccagctacttgggaggctgaggcaggagaatcgcttgaacctgggaggtagaggttgcagtgagccgagattgcgccactgcactgcagcttgggcaacagagagagactctgtctcaaaaataaataaataaaggaaaaagaaaaaaagaatgcaaaatgagtttcacttagactttgctatttgatttattttcttacagcagaaggtgatttactacctctgcatcttattgaaagatccagtggaaccacatgggatatcccaagtagtacccgtcttccaggtgagcatagaatacttttaccattctccaattactcctcaaccttttcattaggaatgtaaattccttttgtcagagtattggaagatacctgacagctgttttgagtgataattaggatttcagttatttgagaagttcctctctgaggcaaatgtattccttaaaaatattcatgcacattttattttattttagagacagagtctcactttgtcacctaggctggagtgcagtgacaatcaccactcattgcagcctccacctcccaggctcaagaaatcctcctgcctcagcctcctgagaacttgggactacaggtgtgcaccatctcgcctggctaattttttttttttatttttagtagagatgaggtcttgccatgttgcctaggctgatcttgaactcctgagttcaagcaattctcctgcctcagcctcccaaagtgttgggattacaagcatgagccagcatacctggcctcatgcacattttaaagaacacaatcaaatatatagcaacttctgcctataaatcaccattcatctactttgactctgtcagtctactactgtacactttttttagatagaggtaattgatcttacattgtacactattgtgtgtcttgctttgtaaataatttaatatgtatgtatcctacaaaggccattatatttattattttaaataattgtataatatattgaaatatcagtttatttagccactcttgccagcttttaaaatcatgcctgggtttttttgttttgctcttacaaaaaaaaaaaaacacttatcagctggtgcagtggctcatgcctgtaatcccaacactgtgggggaggctgaggcaggcagatcacttgagctcaggagttcgagaccagcctgggcaacatggtaaaacccccatctctacaaaaaataccaaaattagctgagcatggtggtgcacatctgtggtcccagctactggggaagctgaggtgggaggattgcttgagcccaggaggtcaaggctgcagtgagctttgatcatggcactgtattcagcctgggtgacaagagaccccatctcaaaaaacaaaaattatacaaacataataaattacaaaataataaatttagaggtaggtatttatgcatgtatttatgtatacagttaaccctgcctcactgacctttttcacaaaggatttaagataagccaaaaattattttgcattgtaattcaaaattattttattaaagcttatgaatagttttatagatttctagtgtttaagatcgggctccagagattggacaactttatcatactttggggattttgtacttctttttctaccatcctggctaatagtggatttagcttttttagcttaatatgtaggtaaaggcattaaatttgtatctctttaaatgataggcttttcatatttccttgtattacctatcagtatttcctcttactttaaactacctatcttctctattagtcaagtagaatctgaatattatgtatttgtatctatttttatatatttttaacaattctttatatattttaggtagtgcacttttattaaatatactttcacatatattttttccattctgtggcttttcttttaattttggttattacatttcattgtgtaaaacatttttcaatatttacatattaaactgcacttcttgtgtttgagggctgttttacaacttgtgacatttctcaagggtccattttgtttttcctcttgcttattcttagagatggagttcatgaaatttagacagattaaaaagctatcatttgatctcccacctcgcatagttcacaagctgtgctgtaagcctagctgggactctttccagcaaggtgtgctgaggcctaaacttcttaactccatgagctcactgctgtgtcatttataccccttgatgtgggtgagagattgaagttgcatgtggtcccggcaccatggctcaagcctgtaatcccagcactttgggaagccgaggtgggcagatcacttaaggccaggagttcaagagcagcctggccaacatggtgaaaccctgtctctactaaaaatacaaaaattagttgggcatggtggttcgtgcctgtagtcctagctacttgggaggctgaggcacaagaatcatttgaacccgggatgcagaggtttcagtgagccgagattgtgccactgggcgtggtggcgagcacctgtaatcccagctactcgggaggctgaagcaggagaatcacttgaacctgggaggcggaggttgcagtgagccgagattgcgccactgcactccagcctgggcaacagagcaaaactctgtctcaaaaaaaaaaaaaaaaaaaaatttgcaagtggatgcagcaccactgcactcccttatattctcaccttgactccgcatttctcccctttggaattcagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatatt

SEQ ID NO: 37285 - DNA, 8904 bp, Homo sapiens
agtcagaggttaacggaaaacggaagctggctggctgagaagaagcttccgttagtcctaccttgaagagaaaagagccagataaagagaaagattaaaagtatgagaaaatacagaagccactggtctcagggagacagagaaggataccaaagaagaagtaactattatgaggggccacacaccagccactcaaggtaaaactacgacatctaattaatttgccatttaaatcagaagtcattggcggctttgggatgagaggtttttaaggggtgttggggagcaaagccacattgccatgacagttatattgcttgagtttgaatctcaactagtttgtgaccgtaggcagattttacagtcttagctgtaaaatgaagatgataaaataatagcaattacctcagcattgttataataagtgaatatatgtaaaactgattagaaaagcaccttacatatagtcagcactcgacattttagttattgttagaataccttgcagaataaatagcccttaaaagatggtgaatagcactgtaaacttaatttttgttggtgtccgtgagacattttaaaatgccagaatggagaaaccagatgaacttttcctgttcaatgtggctgggttaaaatgaaatagtaattttaggcatactgccaaaacgtagtaattcagtgaggatgatccttccagaacgttccagaatgctaaattgttcactagtcacgcacgcctttccccaagctctgcccacttatcctataggctacggaatagtaggtctcctcgcatttctaattggtcttcagagggctttggctccgcctcctggggcaaaaaagtccctgtaattgaacactttcatttttgcttgtccccaggcttgtcgttagaaaagtaggggactttcctgttgagtatcatgtttacaaaagcaaagtggcttttaaattttaaactaagtatcaaacaagtagataaggtggatgggagggatcttcaggaactgaagggaagtggaacttaaggttggaacatcggtgtgcttttaacgacggaccgagctacttccgggagagaatgggagggtggaaaattttgtgcgtttggcgggtttcgctctcttcataagtattgatcattccgcagccctgcggaccggacacgtgaggaggtagtgacgccgacactgccagaacacactgctacaaggtcccagatggccacgtctctggtgagtgcctgggccgtggcaggacggctgggcgccggactccagtggctgagaggagggattccggggcggtctggctgctgctcacgtggataggtgacgaatcacgtcccggctctctgcactgcggggcggggcccacgctttgctgcccgccctgccggccccacccccagcctggttagcagtcgctttctgatcccggaaaggaccctgagctgggaaatagcgagaggcggggatgttggggtttgttgtttatggcttgcagtttctttctctcgattatcttcctctctaaaaatcactttcagtcacctgacaaagaaactggcgattcattgttcttaatttagtaatagactgggccccgtacatgaatgagaaggaaggtattccttaattctccggcacgaacgccaacagcgttgctttcttcggtgtcacagttcttaggcaaacagcagtgaatatttacgcaatgtgggaaagtttcctaagtggagctgccggtttttcaagtagttgaactactttcgtgtgtgtgtgtgtgtgtgtgtgtgtgtgtttcccattcatcaactttggagtttggctctaacacctcacttgaaaacagaaaacaatttcctagcttattcagtggcagtttttgccgctctctctccttttctaaggttcaggtggtgtcattttcattgccgtgaatgtttgtaaaatattgaaagtctaaagtgcttagttgccaagaaaagattataaatttatatgtggagactgaaaaagactcagattcattgagaagattatgtcctaaagacatgcacttaaaattagtgaaaaattttaaaattgcaaacttcagagtccggcctttaaaatgtctgaatttatatgaaagaatgtggactgtatatagagctacatagtggttgaaataaatcatcagcttctgtcagtggttttgtgtttgtgaggggttgaaaaggttggtaatctatacttctggaatttttcttgtaggattttaaaacttatgtagatcaggcatgtagagctgctgaggagtttgtcaatatttactatgagacaatggataaaagaagacgggtgagtgttatagactctactactctttatagactactactctttattaaataccaggttgtgtctggagccagcgtttcatctgacttgcataagtggtaactgtggatttactctttaaaagcaaattgctcagggaaggattggtatggcattagtgggaacatgggctctggaatcatatcccaggtttacttttacctagttctttgacctggagcaagttgccattttcccttaacctcattttattttcaggttggtaagtatgaattaattaaaataccgcacttaacattaggcccagcatattttcttaaatatgtttccttttcttagttccatcaattaaccaatatggttaaggtattattagtgctaatgaaggggtgggtcattacggggaatatttcctgattcgccccttttatttcatatatttatagataatttctgatcatggctcaaaagtatagcttacacccacaaaaagtatgcatgtagcatggataatattaagtcctcaacagaccgagatttcatcagctttttcattgcaacttatccctgcaccatatcttttacgtaattatgtcagtatgtggtcaagtgagtcttgcctaggtctcttaccagcatagaactgtgctttggagaactacttctgtcctgcagctgcaaaagttaataccctatctctaaaaacctattttttatataaaacccatttattaagcataggattttatatatatatatactttaagttctgggatacatgtgcagaatgtgcaggtttgttacataggtatacacgtgccaaggtggtttgctgcacccatcaacccgtcatctacattaggtatttctcctaatgctatccctcctctagccccccaccccctgacaggcccaggtgtgtgatgttcccttccctgtgtccatgtgttctcattattcaactcctacttatgagtgaaaacataactgtgtttggttttctgtccctgtgttagtttgctgagaatgatggtttccaacttcatccatgtccctgcaaagaacaggaactcatccttttttatggctgcatagtattccatggtgtatatgtgccacattttctttatccagtctaacattgatgggcatttgggttggttccaagtctttgctattgtgaatagtgccacaataaacatatgtgtgcatgtgtctttatagtagaatcatttataatactttgggtatatacccagtaatgggattgctgggtcaaatggtatttctggttctagttccttgaaaaatggccacactgtcttctataatggttgaactaatttacattcccacccacagtgtaaaagcattcctatttctccacatcctctccagcatctgttgtttcctgactttttaatgattgccattctgactggcgtgagatggtatctcattgtggttttgatttgcacttctctaatgaccagtgatgatgaggattttttcatatgtttgctggccacttcttcttttgagaagtgtctgttcatatcctttgcccactttttgatggggttgttttttcttgtaaatttgtttaagttcctgtagatttggaaattaatagattgcaaaaattttttcccattctgtaggctgcctgttcactctgatgatagtttcttttgctgtgcagaagctgtttagtttaattagatcccatttgtcaattttggtttttattgccattgcttttggtgttttagtcatgaactctttgcccatgcctgtgtcctgaatgatattgcctaggtttatggttttgggtgttacgtttaagtgtttaatccatcttgagttaatttttgtataaagtgtaaggaaggggtccagtttcagttttctgcatatgactagccagttttcccagcaccatttattaaatagggaatcctttccccattgcttgtttttgtcaggtgaaaaccaattttttaaggcaaaagataaaagaagtttcttgtactgatatttgatgtcagggaaaagggttgtgacaatggatgtttattgtgccttgccttgaatgtgtattgtaccttactgctttcaaaaaataaagtagaaaaaaaaagacaacattgtttattaccagtgtcaatatatgtgttgacctttttttttatttttatttatttatttttttttgagatggtgtctcactctgtcacccaggttggagtgcagtggcgcgatcttggctaactgcaacctctgcctcccgggttcaagcgattctcctgcctcagcctcccaagtagctgggattacaggcaactgccaccacgcccggctaatttttgtagttttagtagagatggggtttcaccatcttgaccaggctggtcttgaactccttacctcatgatccacccgcctcagcctcccaaagtgctggtattataggcgtgagccaccatgcctgcctggccttttaacccaagttacattatagaattaagctaatagtgtgtcttgtgaccccagagttttaactgtggaatttctgcctcatttgggccttaacttatttgacttatcgaagtctctgctttagcaagtactcatgattcttttgaactaagtacactaatagagtagtactatagccgagcatggtatgacatgcctgtaaccccagctacttgggaggctgaggcaagaggatttcttgaccccaagagtttgagaccagcctgaggcaacagagcaggaccctgtctcaatttttttaaaaaacagaataatttttaagaaaacataaacctcttctctaaaaagtgggagtagtgaactaattctttctaacacatgcaaatattaaatgtttcatatatatatatagccactagcattaaagggtacaggtagggcttgatcaaaaactttgttaattctcataattacaaaaggaagacacactaaaactggcttggggctgcatttgcttggaatttgtgatcatttaattcatttgaatacagaaagcagaacttaattgggtggaaggttttattgtgtctaaagtgaaatatgaaaaaatatattttactgcctagtttataaagagtaaggtgatatttatttaaggccaagattataagacagacgttttgttcacatgggtttccagtggagatggagcaaggggagtggagatgaaggtagaactacaaaaaatgtttatataccatctgtaatattttaatccatttctataaaatgtttatctagaaacagaattatttcccttttttaaatttgtctttctttttaggcactaaccaggctgtatctggacaaggccaccttaatatggaatggaaatgctgtttcagggctggatgccctaaataatttttttgacacattgccttctagtgagttccaggtcaatatgttagattgccaaccagttcatggtaagatcatgatctttcaagatgcttcctttgttttcctctagtaagcactgagcttttacaccaaaagcagcgagaaacttttagtggtagaactatttacttacttgagcaagttaaatattatgaaaaatgtaactgtccagtcaaactttggtcttccttcagattctttccactagtagcttttgatggattatgtgattttggcttattaaaagttgtatgaaaagttgagattaatgtgatttttgtaaatggcagggaaagattatctgatttctctaaatagttgcctgctggaccctgaaatgtctccagagtaaaattataccatatctctgattaatgtgttcagtatcttacaatctactaatatttcacagaaatttactctgttatgtgaaaggatgactttttacaagaaaatttgattccaggtagattgatacagtttaataaaacctctaggtggggtcctaagtgtcttaaattgtagttcagggtgatttttttcctttataattcctgaaaagaacaatagtttaagaagcaaagcatgaataagctctgttagaaacctgaaatattaattctgaaatatttatatatatatgaagcaaatggtcctatgctagatataagctcctcattttgaaactagagtatcccaaagttttctggactgaaaataattttaatatcttttactaagtacttagttttctgggtttgagtatgcatgcttaagattatgctcaagggacagaaagtgtatgaaaaaaattttaagcattagtccataaacaatgtattttaagcctgaaaatctgcttatttagagatagaaaatgatgtgttctcttttttttttaatgtggatgaagagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtg

SEQ ID NO: 37286 - DNA, 182167 bp, Homo sapiens
ggcgcgctcgggcctccgctcttcacgcgccgcattcgtagcccgagagtccgcgccgcggggaggcttggaggcaagcgctgcccgcgagctgagccgccggaggaggagccgcgggcaacgaggtaggcaaaggaacactggccgcacggcctggagccttcagctccctcgtcccggcccgagggggtggcgaggctcggggcggcgcgcggaggccggggcgggcggggccgggacctgggggcggggaccggcctggccagaggggccacacggagctgattgggctgtggaagtcggaattccagtcggtgcggtgcggtgcggtgcgttgcctcggcgcggccggccggtcccgggacacggcaccagggaggtgtggaaattgcctgccccaggggcgcccgcggaggagggtaggcgggggcggcctgggccctcccacttttcagggctcctgggccagttcgcccgcacagccctcgggaacttgttaacaggaaagcctggcagagaaacaaatgccagcgttttggaagaactgagagtcacgtcgttaggcgctgaggctttcttttccttccccgccccctgcccaacctcggcccgacttggccaaagaaggatgtgtcaccagctccgggccgcggacgggattcccggcccgccaggagccggggtacctgaaacaaaggtaaacggaggccgggcggcccctggtcctgcaccgcggccgcgctggagcgcctcggtgggtctctcccgcgccgacctggccgccgccgccgcggaggggcgttctcctgggggacctctcgatggaaaccagctggccgggcttggagttgatgttgcatccgaactctgttgtgctcccgttattcccagtcctcccactctggtaaagcttaaggaaattttatccagtcttggtggtcagcaaatgtaggggaagacaaattattgtttgtaaattataaggtattttctaattaggaaatggcctgaaaacattaaattcttaacacgtaagcaaaaaaagagtaattccttccaacatctgaggaagtattcctcctcaaatcttcatttatgtacaaaacatcccccacacctttggtgccaggcatttttctttgttcttccttagtctcaggccttagtttcttgtaaacagaacccagcgcctagaccctaagaattgccatactaggtcagagcatgggcgtccagttcagtaggcagccggcttgtgttgtagtaaaactgttgtttttttttcttggtggtatgttaaaaattatctcagtttctttcagtagtccatgaaagccttttaaaaattttctaagccactgctaatttacacacacaatttatttacatttattgcatccaaatggcccttttatcacctctggcagaagaacttaatggcatgagatacttgtggaaaaaaacttagatcttttatacaatctaggagctcagaaatctaggagatttctaggagaacggggaaacagatcaaaaaggtttttaaaaaacaaagctttgggaaagtgttactggggccaatctggctgttgagttcaaaaatagctttatgcactgacaacctgaacattgagcagttaaagatttatttgtactcataagtatttgcatattttaaaatgtagcttaacattctggagagtgaagggcctatctgactttatcttgggctgaattaatttggccttaatgttcagctgaaaccagctactctgagagaatggaagttttgtttcagcgagaaaggaaaaaaggaaatgaataattttggagtatagggtacttgggggcacctgttcaaatcataactttgcttttaaactcttcagagactcctccttgctcctgacaaacatagtccccactgatctggcccctgttacctttcaaacacacagctgaagcttcacctctgccctgaagctttgcttgacaccccccatcccccaaaaagaaaacagatatttaaaaatcaccaccctcagaagtgcaattgacagctcttttgagtgttatcgtcctctgagtcagagtttctcatttgtagttctgttgacattttaggccaggtaatttctagttgtggagggctatcatgtgcagcgtaggatgtttagcagcatttctaacctttactgaggaatagataccagtagcactccacacacacagttgtgaacatcaaaaatgcttacagacatcgcaaatgtcccccaggaggaccaaaatcacccttagttaagaaccactgttgtgagcagactgctgccttaacactagtgacgcagcattgtcctcatttgcttaggtgtttactatactaagcttgagggcgggaacagttatttatttaacagatttctgaaggcctgttttgccaactggacactagattaggtatggaaatagattagtaaaaacaactttgcatgcctggaccttatagtctaaggagggtgacagatgtatacatgcataaatatacatttatctcattacgattgtgttaatttctgggagaagtacaggcagctctgagtgcataaaacagatgtcctgatgtagtttggaaactggggaaagtttccatggggaagtgacctttgaggtggacggtgaaggattaacaggagttactaggtgaagctcacgggaacaatattccgggcagaaggaacagatgtgaataccttgaggaagaaaggaacagggccgcttttgggaacccagaagccaggaacacggagagtgatgacacaaaatgaagctaggaaaataggcaaaggctgtccactaagcagtggttctcagtccaacactctcatcagaaccaccagaacttaagaccgacgcctgggccctcctccaagcaaatcagagcatttttggtgggttctgctccctcccccagctaccattttccctgtcttccaaaggaataaccactgatactagttttgtatatcattgtagacattttttgtgggcattcaaggaaatgcatatctttcctcttactgttttacacaaatggtagcatactgtacactctgttttcttaaaaatgtcttgggaatctttccacttcagtatatagtttccttatttttttgaatgactgtacagtatttcactgtatggatataccatagattatttaaccattcccccactgacagacatttagattgtttccagtaatttaccgtaaacagtgctacgaatatgctgtttcatatgtgaataaatatatttatagggtaaattcctagaaatggaattgttgggtgaaataaacacacaaacacatatatttacataagtatatatttatgtaatgcgtgtatatgtgtatatatttgtaattatttgtgattataaaatattctggtcatattagaatgctttggaaggaaacaagattgagtgtgggagacagctgcccctaattaaggttactgtggataacataggagagaaaaggtggtggctgagagaaaagaatggtcgtattggagatggagagaagtacatatattcatgagatatatttaggaggcgtaattgataggatttggtggttgatatggtacaagggttgagagggagaaatgagatcctaagatgactcccagggttctagcttgcccaaccagtgaatggtggtggtgttacctgaagtaaagaacatttaaggataaatagttttgagatgagtttaaatcacagtttacattgggactgctgagattttcaagtgagaggtcacataagcatttgacaattctaattcagagccaagagcagagggctaaactggaggcacgaatttttaggtgtaaattaaaggctgtggatgaaattatctagggcagtggttgcaaagcagtagcctacagctgaatctgactcacagatgttttgcccatacagtggttttgttattgtttaattttgaattagttgccaatattttaaaatctgaagatttctcatgaaaaatccagatttggggtttctctttaaaaatgagaaaatgtagcactactgagttggttttccaatatggcagcaataattggagctaagtcacagatgatcgcagctcttctatttcactacagagcccaccactccctaaaattatgcctggcccactttgctcatttatttctctgactgtaggcttttgagcatgtgatccctggtctgggaagagagcatagaacagtgttctcatcttggttgcacattggaatcactgaatgattaaaaaatgctaatgctgtggtccacctaagaaatttctttttctgtttacttgatctgatttgctgccttggacgaatctgaggtgattccacttagctgtggaagttgagaaccactgacagagattaagaaaaaagggctcaggcccagcattttgaagtttagtagaggaggatagcccaggaagagaatgagaagtggccacagaggtacagtggaatgacgccttgctcagaattaaagtgtgcaaacttaactgaatgcgctctaccatgttttttattaaatgagagagagaaaagttttatttacttgtatacaggtgtgcgatatttaacgggccatttaaaggattttcaagagtaatttaaacaatatttggtttttgtcttagctgtttccttcacaatctaattctagtttaagatgcatcataaaaggtgagagaagaatgtttcaaatagagaggtgtcatcaagtaaagatgtggaacaaaaatgatctgttgaatttagcaagatggagtctttgacctcagcaagaaccattttagattggaagaggcagaaaccaaaatgaagtgggtaaaaagtaaggaaatgggagtggcaagtgttggaaattcctttgagaagcttgcccaaaaagaggaagtggtgagggaggatgaggtgtcttacatgcctacaatgtaggtgttagtctgttggttactcaaacatttctcctaactttttagggatgtaggtcaatggtgtctgattacccctctcccacgttcttaggggtcttgttttggagactactttttactgagaagaaattttgccaggactgttgaaggggctgactcagatgttggtgattaggccacaagtttctttctcaactggaaagctgtagagctcctaaaggccagtggtgatctgggctccagtgaccctgacatcatcctcccattgagctgatgaacaaagactatattgttggtatgctgaaaatggaatacttggctatgttagggaatgtgtatctaactgtgagattcccaggaatagtttttgcagctgtattttttccaattaacttgatattatagcttaattttccagttgcatgcatgtaaaaactctcatactttgaagtatttatcattgatggtacctgagggatatggatgtaagttggagatgtaggccctcattgagctcagaaagaagaaagcactgagcaaactggtttccaaaaagttgtgtgaaggcttctacctcgaagacttggtgttagagtgactatttaggatgggttgtaatgcaaatggtcacaaccagtttgtcttttatccatttctgccacattggcaaccttaacctagcagagaggcttttaaggtcaattttgtgcttcatatttctaagagttgtagcctgccaacagaacagaaaatataaggggtggaaaatgccaagaattattggttaagaatggttttgattaattgaaggcataaacctcattgctatactcttgaaaacaggaatatcatcttgtgagggaccagacttcatagctgtcattggtttatcagttaggtggatgatggttaacttctgtataaaggatgactttgtgacatgaaagcagaccttggtccaagatggtttgtaatgtgagtccattataagaaaatatcttatttagaaacttgtgtatgcttggacagctgtgggaattccatcatcacaaatatggttaggtactatgcctggctggcagtatatagaggcaaaagtccattaccaaggtggtccagagctcctttggtttgtggaggaaacaggatagctgagtggggagaggacttggagtcagttcctgagtatagttcctggatttgtcaagggtgaactgtgtgattttttttaattgaggtaaaattaaccattttaaagtgtacaaatcagttacttcagtatgtacattcacaatgttgtgcagccatcaccgctaattctggaacattttcatcaccccaaaaggaaaccctgtacccattaagcagtcactcgccattcccctttacccctaccgtctggcacccgccaatttgctttctgtctatatggatttgcctgttctgaagatttcatataaatggaatcatacaatatgtaaccttttgtgcctggcttctttcattcagcacaatgtatacgaggttcactcaggttgtagcatgtatcagtacttcattctttctttggctgaataatactccattgtatggatatactacgttttgtttatcagttgacatttagattgtttacaccttttggctcttataaatagtattgctaagagcattcttctacaagtttttgtttaaatacctgttttcaattcttttgtgcatgtatctaggaatagaattgctggattatgaaataattctatgtttaaaaagtttttgaggaactcccagactgttttccacagatgctgcacacttttacattttttccagcaatttttgagaattctagtttctccacctcctcgccagcacttttgttttctggttatagccatcctagtgggtgtgaagtggtgcctcattgtgatttttatttgtatttccctaatgactactgacgttgagcatcttttcatgtgttggccatttgtgtatctttggagaaatgtctgttcaagtcttttatcaattttttaattggattgtcttttggttgttgagtttaagagttctttacatatgtaaatatggatacaaatcaggtttatgatttgcaaatatttcctgtcttactgtgtgctgttttttcactttcttgttagtgttctttgcacagaagtttttaattcgtgtgaagttgaatttgttttttctttgattgtgtatgcttttggcattatatctgacaatctatcaccaaatccaaggtcctgccagtttactcctgtgttttcttctggcaatatatagttttagttcttaacatttagctatttggtggattttgagttaattattgtatgtgaggtaaggattcaacttcattcttttgcatgtgaatatccagttatcccagcataatttgttgaaagagctgtgtgatttatgcaagtctgagactcttatttgtaaaatgaaagtgataaaaacacttgcctcacaaagttgttgtaagattaaataggagaggatatatgtattaccactttgaaaagtatatatcattaaacaaatactcatgattattattggcatgccacatagagctttcatttggtcaaggccgcatagattgatgtccttcagggaccaccacacatcttccctcttagtgcatagtgaatcacgacgtaactaaaggactgtgatccatgttgtatccctaggtccaaagtcacagggccccagatgcaagaggtagttggagagattgcagctatccagaattgaaagtatattttcttgtagggcatgtgtttgttgaattctgttgctattcctcatattgaggaatgtctattctaggtgtttaaaggccctaaagagttttcaggcatagtaggaaattaaaaggcagtttcttcttattggaccaagaatcctcatgtttcactctatcagcttttaaacttccagaactaagactgtttaaatggctagtgatctcacttagttcagtcaacaaatacttactaatttatcactatgtgccaggcactgttctagataccggagatatagtgccttttaatataagaccaaactctcttgactttgcattcccctctcaatttgttttctacagttatctaactcactgactccagttccttttccaccagtctctcttgagtccacattaatcaggccccttcccccactgaagcactcttgtcaagctcaccactgaccttcatgttgctagctctagtgaatcagttctcagtcttcctcttacttgacctttcagcagcattttacacagttgattattcctctttctttgaaacgcgtccttcatttagctttgctgcattctctgcatttccctctcaccttattggaggtttagtctttttgctagttcctcatgatcttcctgacgcctaaaagttggagcattacatggctcattaatactccattcttccttattgactcttatttccttggcatttcagtcagtctcatgactttaaataccatctatacaccaacaactacatgctgactaccaaatgtatatctccaagttaggaaggaaataactgcagtaacgtcttttccttgcttatgtccttctctgacggcctattcccaactcagcagccggaggaatcttgttaaaagtaagttatccactcagaggctttacactttcctacaaggcccctacataatctgaactcctctttgtctttctgacctcatctgttactgctcttccctgtgcttgctttgtcccagtcaaaaaggggacttttttcttcttccaacaagccaggtatgttccttccacaggacctttgtttctcctagtaaagcttcctccctcgttctctgtctcccttccctttcaaactctgcttctcagcactttggggtaaaagggaggggtatcctcccaccccaaccccctagactgagcactaaggctatccccttcctcttgtttgtttattcatcttacactttcatttgaacagagttcctccagttgaaaaagcagcttgaaaactgcttctctgtgagattagaaataaaaagcagagattagtggttgtgaatggaaatgtcattaagggcttaggaatcctagcaagggccacttatcccttccattttgtagatcgtaggcatatttcctattttacagccttggggattgggccccagaatactgctgttgtgagtactgatgtgctcctaccaatgccaagtcttccatcaagcactgtggcccagctgttagcattttgtcttctctcaacatgatacatcttggcagtcttggtattcttctagtagaaggttgagacccctttcccatggtgggccctcaatgagtggaggctcactgggtgctggcagcagtattgagatccaagtattaaaggcaattgagggttctgtgtaatgaagagtgtgttgattctactgagaaatgccccaggccttaaaagggcaaacaggccacatctagtgacagtctatctagatagcaagtttagacacttcatcaggggcagtgtttctcagcctttgtctgcaaacctacaggcctttatgtgggccctctggtgggttcatgttattaaaatctggaatggtgtctgttctgatttgttgttttagaagaaaaggtattatttctaagaattttagccaaacaagtattatataaatacagtctctttgctttccttttcctagatgagctgatttcctagataataaacaagtagataaattaatataatttcagatagtagtaatagtgctatgaagaaaataaagtggagggcttttcccctgatgctgaacacttgggttgtttccaatttttccgtgttttaaacattactgcaatgaacatcctggtacttgggcaaatgtgtgaatgtttatattgcatagattctgaaaggtggaattgctgagtcatataatcatatagctaaaattttaattaaaaactgccaaattggtccccaagttatctgtactaatattacatatataagatatatataatctaattaaaagcactgataatattgaatacgttctctttgtaagagtaattaacatactgttaggctaaaaatcttcataccctcaccaatttgtgaatttttgcctctcttaaaagttgtacaaaatggtatctccttgttttaatttttatttccttggggctgaatatcttctctaaagtttttgattatttgtatttatttttctgtctgttgggttgcatagcagagactgctggttacatcctgtgatccattcttctttcatctttagtaataggaaccccagcttttacccaggcccattgttgcccatgtagaacacttgacctccttggagctaagtataactgtaagtttcggctagtgatatataagcagcaaaggttaaatgtgactctctgaagtctccttaaagggagaaagcactcctttcttcatcccttcatgtgtcttatatgttggaacacagatgtaatgactggagcactagtggccatcataaaccatcaggaccgtcatggtaggtcagtgagccaaaaaggctggctctcttgagcatttggcagagttgctgcactaagagggaagactttctttagcatgagaaggaaatttaacttgtattttgtttaagcactcatattgcatttttctagaatacacaacataacaggtgcttgccttttcttgtttatttatgttgtagataaataaacttaaataaataaactctaggtaaataaactctacatactcatcctttattataaaaatggcatatttcctccaatctgttggagtcctctccctttgtggtatcttttgttaaatagtagtttttaattttgatggcaaatttccctatctttgccttatatggcgtttgattttacttaactttaatacttcttttctgccccaaagatacacataaaatcttactttttaatactatttttaaaatttagatatttaagttcatctgaaatttatttttgtgaatagtgtgagggaagaatcttgttcagttggccattcatttagaataataattttaataggtggcatgtcaaattatcaattactaaattctcatatgtgcataagttggttttaggactgtgtttggtcccattgatctttgtttctacaccattaatacatttcaaattgcagtagttttataatattttttcttggtaaggcaaggtcctcctccattctatttaaaaaatgaaatatatttaaaattaaatattaaatagctatagtagaatatttgtaaaacatatatataaggtgtaaagcatagcaatacaatgaacacttgttaccactcaatgttaaggaaaaaacattaccattccctttgtcctcccactccaaagttgtcttgactcttctggcacattttctaattgatgtgaaattttagaattagattataaattgctcttagaatcaatttatatcattgacattaataatagttctgtgtcaataaaatatttaaatatttttccacttaaagataacagtttgagtggtgtgatgcaaacatacagtcgttagaagatattgcttgaatgtggtcatgatctgtaatcattgtttattgtctgctttgttggtttttaaccattacactgtttttaattgtttttagttgcatttgtggttttatttgtactcataatggactgttggttaaagatggagcatgtgtgcaacacgtgtcaaaatataagttaaagagcataaaaaatataattgtgctaaattattttaagatgctctttattaaatacataagttgcattcatctgatcagcattcttttttttttttttttttttttttttttgagataagagtctcactgtgttgcccaggctggagtacagtggtgcaatctcagctcactgcgacctccgcttcccgggctcaagcgattctccagcctcggtctcccgagtagctgtgactataggtgtgagccaccactgcccggctaatatttgtgtttttgtagagacagggtttcaccatgttgcccaggctggtcttgaactcctaagctaaaagctatccgcctgcctcagcctcccaaagtgccaggattacaggtgtgagccaccacacctggctgatcagcattcttataaaacatcaagatatatctaatatttttaaaactgtatgattaaaggaagccaggtgaagggtgtttctgtactctttgcaacttttctagaaatgtagagttatttcaaaataaaaagtttaaaaaaatcattataaagttagaaacatcagccaagcatgccttatatttaaagttatacatttatttacatatgcatgtaattggcatttattatttcctattcttaagcctgttctagagaaaataatttcaggttggttcaccaaatacaaatagtaaggtaaaggtactctgttgaatctcatgaaagatagcataggcctaatcaaattaagaggctttaatttctaaaatgaattgtcaattgaaagacccaatgtggtattaaataattaggaagtggatttcttgaaaaataattcattttcacctttgtatatgattggtgttgtggacaactggattttttttttttgtaattgtaccctttagatagttaaaattctaaaaaggaaaggtttaaacacttgaaaatgtgaagaagaaaaaatatgggtgattctatccagtttggcttttcatttattggtaataaaaatctacaatgtgttacaaagaaattctctcaaagagcagtgtgaaaccatttcttctaccttgacatttaaaaactaaacccccaaattatcaaaataagcagctgatctttataagctcgaaaatgtaagtatcaggttatagatgcagtttgttattttggatgctataatacaaattaatttttaatctacatttcaatatacatttggtgctaagtccatcttctcatcaacctgtgattttctttacatgacaaaatagttcatctactctgaatggaagttaaaatttttccttaaatattatcagtattaaagattatgccacagaaactttgtaatacaatctttaatgatacgctgatttaagataaaatatttttacctgaaattgctttatcatatgtcataaaatttttgtaaatgattttaaaaatttctaaggaagtttgcagtattacttttaaaatatttatttggccaggcgtggtggctcatgcctgtaatcccagcactttgggaggctgaggcaggtggatcacctgaggttaggagttcaagaccagcctggccaacatggtgaaaccccgtctctactaaaaatacgaaaattagccgggtgtgatggcacacacctgcaatcccagctactcaggaggctgaggtagaagaatcacttgaactcaggaggcggaggttgcggtgagccgagattgcgccactgctctccagtgacagaaggagactccatctcaaaaaaaaaaaaagatttatttgtcaaataaaaggttgagaaacattgatctgcattaaaggcctgaccactgaaattgtactgattgatgtccgattggatctggattcagattggccagcctggaaaagacataccgtcatcagagtgtgggaacacgatgtgtcatatgatgggtccctttaactgaagtacacagcgttgctgctcattttaaaaggctaacaagtttcccctctcaatccatgttgttgctttggttgtaaaagtgggcacatgggcacatgtattgctcatcctgccatcattataataaaagatcagaatgtccaaaacatactgggcagacaaaaaaaaaatatggtaagtatccattacatatgataagggttttttggctacagattaaatgaagagagacaccaagagagggaaggaggcagagtattatgatagcaagagctgaaagaaaaatagatgatcaatgaagatgtatatttgcatgttgtagaaattgattggttttaaggaataaacatccatttaagtaaatccactgtaagtaaaatattgtttatagttaaaatactcagggaacacgttagttcattccaattttagtaagtacagccgccatcatggaaaatgaacatgcttctctttctgtattatgtctactctgttttcttaacaccagtgtctcctgccatgttgctcatcatgaatgccccgaaagagtggcctcaggcacaaaatgataggacctttgagactcagagctctcagctaattgacagcatttcagtgcttcaattcaaagtccccaggacagaaaatataattggtctaccttgagttagtgtcccaaccaaattttccagagattggaaagcatgtgacacatagtttccccatcttgcctgtgaacaaggcaggtctctaagaagtgggtataagtcaagaggaaatgaacgaaatatcttgctcagtacataagacagaagacttgtttgaaaaggagttaattgctgccccaagccttgggggattaaaaaaaggagcataaaatgttccaaaaaaaaaaaaagttggtaagtgtataatagaaaaggaaggttaaattagtttataacatgaactacttttgcactgggcagctttattgccccaataaaatttatagatgattcccacccaacaggaacgagggactttaggaggtgaggtgaagtagatgactggaactttaagtatataaccaaaaatttccataaggtgtatagactcctatacattggtatagaccatcttggccaaaatctgtttcccttaagagccagttgccatcatgataaagcctgtttaggctgatgcctaatcaatctggtgatttccatgaagttccactcagttcagctagcttggtaaccactgatgttcaagtgtcttagttttcccacacccacgtagtggagtttggtttgtcttgagctgttcttgcatagcacagatgagtggtagcggggcatttacaaggaggagcaccaccaggtgtaggtgtactgaatgacagtggtaacatcagaagctcttaatggtttccagtcatcagtacatgtatgtcactttgcctaaaggagcaaggcctggttgacagaatgtcctaaaatgtttggataaccagatgcctatgcaggaatgtgttctctggggatttggacataagctctttaagtttggtgatcatggtgatgtgggtccaccttactggtgagccagacgactattcagtaattagacttttgtaaagtaacttgcttagctgtagtagattcataattgagcatcttgttggcggtgtttcttggtttgtatgttggggagttgtgctgggtcttggagctgtagcagattgtcttctctactttgcctctctgtattagaggatttgggatgggggccaggggtgctggtcttaggttcaaagaaaatgctatattttttcatcagttaaaatgccaaatgaagctgaacaactctcagaaatggtcagtaaggccactttatcctagatggagccagttagcccttccttaaaactgattacaaaaagtgacctttttttctagtccaggtcttggccaaggaaacagaagtggtggtatattagcaatttgccttcctcctttcttccttctcttccttcattgagtacttatatatactaggcactgttttagtgttaggatgcagtggtgaccacagcaaacaaaatccttgcctttggagtgtacattctattgcagggataaagacagtaaacgtgtaaacagtaaataaagccaagaactcataagttttatgaagacattaaactacataatagggcagagagtaatgagaaggggccagggtcgagggagaggaagaggccatttgaagaaaggaaggccaagggagaatagtacaagatgaggtcagggaggtggttagcagactgagctattaaaggccatgggagaggagtttagactttgttcaaaatgcatttaaacaggaaagcaattcactctgatttgtattactctggtagtgctgcttgcagaatgactggagtttggagaggcaagagtggaagcagggagaccagttagaagtccatgacagtacttcaggtgagagaagatgatggttaggatcgtgattctaacagtggaaattaaaagtggtcaaaattaagagatatttttgagatagggttgacaggtcttactgaatgagtttatatcctgggtctgggctgcacatgtggcagttggccattccacttttatgaacttgcaaacaagttcatagcaagacatctgtaaaaagttctgtttcacaataatgtactccagttgtgcatctactgggtcatcgggttctttgtctatataatgggtaattaataacaaactcttgttgggcctcatctgcaaaatacagggattcctgcagtcccacatgtaggatgtccgctgaatgaagaactttggaagtgtctcaggttctcattatacccttcagggcacttgaggctgaatggcggtcaaaggttggtgaagcagggtgggttgctgtcctgaccctagagttggacctgtcagctcagcctcacataccacatatatgaccaggaaataaaaaacaaataatgaacaaccttgctggctctcttacagcagatgagtctatttattctcaaccctcccactctcaaattcctgactctgtggtcaacctctgtaccccttctggtcttttggtttggactcccctttggattcttgaagttgaaccttgctctcagttctgctttcccatctgatctcagtatcatcttccccaactccagccacccctgcaacacatgcatacacacacacctttcataatattgaatgaaaaatttcctgccgaaattatggccacagaaccccactagaggtggtaattcaggcttgtgtcctatgggtgattttgcttagttaggtggtactattgagcccacaggatcataactttttacctgcatttgtcttacagacagatgagtacttcatgcactcttccaattggcaagcttagtgcaaaaatgaactaataacgttagatgtgataagtttatagtcttgcttggttaaatagagggcatcagtggggtcaagaaataggattccaaagccatatccagggcaggagctaagcaatgggttctgtcaagggacacgtgaggactgtgaaggatcagctcaaagtaatctgcattttcttcttacagatatttccactgggcttttgccccatttctctacccaagtttagttttggggtgtgcttcacagaatctgaccgtttatccattaagaaaatattattgaatttatattttatgctgtgcactggctatgtggtggggatatgaggatgagtaaattgtgatggctttctgactcatctgcgtctgcttccctgattcatcacactgccacctgaatcccatcatcccccttcctgaaaaactataacagtgttataaatgcttaatactaaaaagacaagactttgcaaataagtggaaattacttcaaaatgtttcttcttttcagtgcatttttgcttttctatttatatgtttcctctaaatcaaatcctacgttttactcttctgttaagtttctttaaattgctttgtcttgccctgatatttgtgttcttccacatttagagccttctgcatcttctatttgcctcttgttgatttaatctcacaggtcattttttaagtcaggctttatgcttagccttatggcatgttttgtatgtaattctatttctggatatgatgccatttgtgaacatgcttttaattatgtcctagtcagttacattattgaacaagctcattgttttaagtatacttacaaagtttgacaacaaacttatagcctgaagttcagagagaggtagcacttaacattattcattggtttttaagagtcacctgtaaattttactccattaactttatctgttatgactttttttatagctattttatgtgtcacagtttattagttttcaaactttttgaaaaacaaaattggagtttaacagaaatccacctttttgttcatcctatccaggttactataacaacttcagtgttgtatagattttccctccctccttccccttctaactacccttcctttcccttccttctctttccttcttttatttcctaatttgagagttccttccctagaagttgagaaatctggaattgtagcagggatttaggaactgactaccccagctcctttagccttaatatagacatagtatatgacaaaagagctttgatcttacagaaacctggactcaaatcacagttctactttctgagtatgtaacatgcgtaaatttttttcttctgtaagcctcagtttcctcatctgtgaaatagagataacacttcaatgttgacataagaattaaattagatgatgcatttaaatactcagcacaatcctagtaatatggtttggctttgtgtcccaaccaaatctcacttcgaattgtaatccccaagtgttgagggagggacctgctgggaggtaattggatcatgggggcagtttcccccatgccgttctcgcgatagtatgtcctcacaagatctgatggttttataaggggctcttcctgctttgcttcctctgtttcctgctgccatgtaagatgtgcctgtttccccttccaccatgattgtaagtgtcctgaggctttctcaaccatgcagaactgtgagtcagttaaacctctgtgttagtccattttcacgctgctgataaaaacatatccaagacggggcaatttacaaaagaaagaggttttattggacttacagtccacatggctggggaggcctcacaatcatggcagaaggcaaggaggagcaagtcacatctttcgtggatggtgccaggcaccaccacgagagtttgtgcagagaaactcccatttttaaaaccatcagatctcatgagacccattcactgtcacgagaacaggacaggaaagacctgcccccatgattcaatcatcttccaccatctccctcccgcaacatgtgggaattatgggagctacaatatgagatttgggtggggacacaaggccaaaccatatcaacctctttcctttataaattacccagtctcaggtatttctttatagcagtgtgaaaatggactaatacacctagcatgtataagtactttaaaatgatgatgtaataatattaatcttctctttgaaagcccagtacaagaagggtcagcatagcagcacacctccgtctctaacccagtcctgctcactttgtctctctctctctccccctttccctttctctctctctctctctctccccgccctctttccctctctcccttcctctctccctctctccctctctccctctctctctcgctctctctgtctctctctctccctctctctcacacacacatactcttccctacctaaggaatacaagcccaagattagaggatgcatgccaagttccctcctccttgctgtttatctgttgatgaaggtagcatgaatttctgcagagagtagtcttacacctaatgtataaccgttcctttgaccctgccagtggaggcatacagacggattgtcttacttggaactcaccagtaaactttttggcaaatgatgcatctccagatgtatggttattaagatgtactcttagatgttctaaaggcttaggatgtgaccatgggataaagtgactgagacagggtagagaacaagatcagcatgattaatgttgtgggaaaaaaagatcaagaaactaaggacagaatatcagatgaattatttgtttggatgctaaaatcagtaagacttatgacagaaatagtgttggagtgacagccaggaactaaaatcaaggaatgaaagggaatgactttggggagccataaatgactgcaataaggaacgatagtaggcagtagagtctgatggtatgtaactcagagcagaggatttttggagagcacacagggagaatgatctggaagcagcggtgaggaacaagaaaggcagttaccaggactcatattttgaggagtatggaagagaaaaagagtcatcatctaaaagggatacagggaaagcagcgttctcaggggagagttcagtttccatttaaatatgaaggtaaaggaagttgaagaaagctgtagaggtcaagaatatgaggattttgctgataactgctcatgagtcccacagggctcagcggaagggttaagttttcaggaggtagaaggggtagaggcttagatttcatcatcagtcaccatcatctctcccttgcatacatcctcaattcctctgaccctctttcacttcagcaaccttgcctggctaacccacagagccagttaaatccagttctttgcctattctatgcctgtaaaaccatgctgctgaacttgacatattaattatcatatcctcaagtggacccttaatgttacctggctattatactagatttctccagccattttctgtcagtttcatctcctatttgatgactatttcttcagtctccttcatgttggatacctcctccccactcttcgctctcaactgatggcttgcttcctatttcaccaagaaactgagtcaggaaggagctttatcaccacagctacccactacccgcagtagtatccatatactctgctttctttcctgttagtgtgaaagaactaccctaagtgctttataattctttctgttgtgtcatcagctttcctttcttctgaaccattctcttgtgcatgaacatatgcttttatttcttccatgttaaaaacaatccttcttgactccactttccactctaacttttgccttatttaatgtaaacatcgtagtaaaacttatttaaagagttatttatgttctgttgcttatttttcacttcccattctttttttaactaaagccagtcagacttcttcccccataattccaataaaactgctcttttcggttatcagtgatgtccacatctgtcatttctcaacacctatctgacttaacattcaggaacagagttgatcgttcactttatcctccttgaaacaccttcactgggcttctgagatacttgtcaagaactctgaaggatctaagagtttactgtatttgtatactaacaagttagtatgcaacagtttgatgtataatggtagaagacacaagacttctggatcagagacagaagacagtttattacttatagcagtaacataaccagagtatcagtatttttgtgctggtttcctgatcccaagttctcctagggcaatatgaagaggccagatgacacctgcacacacagtaaggctgtgttattggaaaggaaacttgatcttaggtggaacccaaatcttttataatgggccataagcatgcttgctctttgtttcagagggaaacattatctttattatgctggacagtaacccattgctctggagggagacactaccaagtcttccaaggctattcagtataaaaaacatccttgaaaagatagtctagaactgtcatgtgtcacatcaccgactatcaagatagtgcctcacttacaatatttgcagaaacataagagacctatggagaattgactcacagtaattcttccctctctggccattttttgtcagtctcctttgctggttcttcttcaattcgccatactctagatctacactgtctagtactgtagccactagctgcatgtagttatttcaattggctgtatttcaagtgctcaatagccacatgtaggaagtggctgctattgcatggtgcagatataaaaatatttcatcatcacagaaagttccattggacagtgccactctgcatgtttgaagtgccccatggctcagcctttggatatctcctttttacttctgtattccatcccttggtgatctcatctagtttcatgactttaaaaaaagactcccaaatttctatcaacccggatctgtcccctaaactccaggctcagttctctagcagccctctggacacatgtacctgaatgtcttaataggcatcttaaagttaacatgtccaaaactgaactacctgaactaccgattctccttgcaaccactacttcctctcccacaaacaaatcttttctttctgcagtctttccagtctcaattaatgtgagttctcatcttcagttgttcaaggattaaaaaaaaaaaaaaacagtttttttaaactcttagatttattattgacctctctgttttctataaaacccactcatgtatcccattggctctactttcaaaatatatccagaatctgaccactttgctcctgctaccacctagtccaagccagcatcatcttttgcctggattattctaatagccctccttctggtctctctcttctactcttgtcccctgtagtctgttctcatcctaacagccagaatgattttgtgaagaagaacatcaggtcatgtcatttctctgcttaaaactcctcagtagctttccatctcacttaggtaagagcaaagtctagtcacactggcattctcactcttgctaaaacattcaagccatgctcccacctcagaacctttatatctggtgttccttttgcttccttttcccctaacccacccactgaagacaccagtccagttgtcttatagaatgatccatactatgaatttctctgcttcctcatggtattaatttatttctctatagcctgtattttctggaattggacattagatctaaaggattgattagattaattaaatatttttggtgaggaaattccatcaatgatgctacagtcttgacattgaatcattttgggaggcacctattgattatctcaccattagtgacgccaagtttgtctaacgtgttgagatgggaatgttcgtatctctccattatatatttacatttttcccttcgtggttaacaaaaaagctgaagggtgaatgctatttttttttaacgctgttattttaagaacactttttagctgtggaaatgctttttcaaataaaacgttttttggagatccagtatctaaaacagataaaagcagagctgttttgttgcagtaggaaatgcagcttccaagggaactttgacaagcacagtttttaacccacaaggcccacccaaacacttgagaaggtggagacccagaggacacatgaagtcttaaagccacctagcatctcgtgagaaaggctcagtacaccttctattagagcatagtttgggagctctgccacttccttggaaagctgtggttgtgaatgatcattagaatgagacttggtttttccctggcagtccacccgctgtttttagttgtctcagtgctttcttgacattctatctatctgttctgcagatgtgaagatttgaaattacttcatttatagtgtgtgttgggttgcagtcctttttttttgccttttggaaattcttcatccacaaagaattccagattcagacattattcatctatgtctggaacacaaaaaaatctcctgagcttccatatgtcttaccttctttctgcctttaaaatagtcagaatgctgccacagctgaagtcagttttctcatttgcttgttgcttgcttcctttctgtaccttacttaccatacagcctaacttgccttactagagagttaaatgagtaaatttactgtgctcatacaatatctataagttgtatactatagatttttattttcagggaaagaagtttctctatattaagtggaaaaaaacaggcaataaactataatcttacttttgtttaaaaagttatatgcacaaaaatctccatgactgtttatgtgtatatgtatatttaaagcccaaaaggatatttacaaaaatgttcacattgatactacctctagctgtgatctttgctttcctctttgtaatttctctggtatcactctcacttttgtttgtagtgtgtcttatttctacagtcattacttttataaagattaaaactattgtttaaaaagacaaaacagtaactttggtttgtcaaatccaaactgccttgaaggcgggtccgggcaccaccccagcttactgccatccgtaccattctttgggattcttatcttatcccaaatgagcagcttttccctgatctcatgattccattcttttacaataggttcttggccgtcctctagaatccactaggcgctgaagaccttctctgctcacttgtatcaaaatgaacttgtcagggaagggaaggaggatgtaaaaatgaagttctaaaaggaattgtcactagaatgtgatctccatcaggacccaggaggagctcaataaatacctcttaaatgaattggcctattattttttgtctcatttattttatctcacaaattcctacaaacaagccgtgtttgttttctgtaatgccctgaacatttggagtacttaatataaattaatgaataaagtccttttaaaaataaatccgtacttaataaaaataaatttcagatttcttgttatctttaaccagaatttgtgcttgtacaggaatttagaaagggacaggacttaaagataaaagtcttacgttagatcccgctcacagttttgtgatcatgattagtcaacttaagcccctgagctgccttcatttatagcctcacggattctcttctagactcttctgaggccttctacctggcctacctagcttcatcttgtgtcctcaagtctgccctccacaatgctacaaagagtaatatcccacaatgcacatttgatcttgtctcctctcgcagccacaatttgtaacctctcgggggctttctgatgctgtgttgcctttgccccactccttcagctttggctcctggaagcctgtcttcaaacttgagactcaaataataccaagttcctgctagctcccacacatcccatgctgctttctgctttgctccctcttacaggacgttttcccttcagccaactacactactctattccaggactgggtttggcagatcccctctctggtgtgtcgtcttttgcgtaaaggttatgtatccactgtcctgcccgctcagactgtgagctgcttgaggcaaaaccatagagttcatagttctttatgttgaagggtacctggcctgtagtgggactcaaatgtttattaaactgtgttgtaaaatacatgtgttcttctgaattgtctaaatgatttttacccatagaatgttacctgatttttatatgttctcctccaaaataaaaaaatacttagaaaaggaaattgtgtgaattaaagtaacttaaaatatagctagacagaggcaaaaactattggtgatattttggagtatataataaagaattttttaaaattagaaaatggtaaaagtttaaccccaaatattccttttggagatagttctcagagaaagcagtagctttgcagattacatgcattaaatattaatagcctattcatcatacttcccatatcaaataatacaaaatagttctctggtaaaatgtagccctttcttaattcaaaccaagaaaaaacaaattttgcttttctcatgttccctagaccccagagccatttttcatcctgtttttcctgaagaaaagataaaatccctgtgagggaagtgacttgaccaagttacccagctagtcagtgcagaagctgactgcccacctggtgctttttcccctcagccacacatttcctgtttctccactgcggtaaaaataaaagttagtttttaagcgcttcctaattcccatgtgttcaaatcaggtccactgctgaatgtttttatattacccttagcctcattcagacattagccctaaacctaaagcattaatttttctgtcatacccatgtatacactttctttgagcatcagaaaatcttttctataagagatgttgtattttctcaactatattaattttatttattttattttttaaatttctcaactatttttgaagtggacatgacaaataaaatattccaggtctccttttttattccacaaataggccttactgtacacttttggtattcttttaaactgttctgttggaagcagtttccacactgagtcatccacccaagattgcctatgttttccaggcaaagtaatagttttattatttctaaatgactcattacttctgaatcattacaccttgtgttctctgttaaataaaaagttttcaagacaattttctacagtttttttctgctcctagtcttcaagtgatccacctaagtggcatggacattcaatcaactctgtcttttctttatgattgatgttgatcatttcttctttaaccctttcatcagctgagataagcagtggaatttctttacctcatactctgctccagatgtttcctgaagtggaacaaataaatagcaacatagtatgtgtaacaccgttctataatttccatcattacattaatgtttaagattatattaacttcccaaatttctccatgaaattagggagagacaccccaaaaaatgtagctctaatatctgcagggagatgaattcagcttcaggcatggatttcagtacacattcaggagaaaatattccccatgtagttaaatatacttggcagtgaagagaccggagttaaagataaatatttgagaggaagcgccagataaagattttaaggccacaaaagtggacaagatttgagcatatataagatgagaaacggggcaaagcacaaaactctgaggaagactggcacataggggacaagaggagagatgcaaggaaggagacagtgaattttcaaagggcaggtggagaaccagccaaatatgtcccaggagtcaagtgagggaagtgtttcattcttttcaactataaagccattgaaaatccatatgaccttaggataggcaaagatcttaaggtagtatatataaatgtattaactataaaagaaaaaatgattaattggattgatgaaattaacttacagaattaaaacctcctactcttcaaaagccactgctaagaaaatggaaagagaagccacagactgggagataatatctgtatttaaaatatatatgtaatgaactcttagaattcactaataagagatgacccaaaagattctggatagacacttcacaaaagaagatatatatgaatttttaataagcatatgaaaaaatactcaacatcattagtcagcagggaaatgcaaattaaagccacagtgggataccacttcacactcactaagatggctaaaatttacaagtatctgaaaggatgtagagctactagagctctcaagtgctgctaagggtataaaatggtagaaccactttggaaaacagttttgcaggttcttataaagttaaatgtacatttatcatgatgcagtaattccattgctaattacccaaaagaaatgaacacatatccacaaaaagacttttacttgattagtcataatagctttaaatcataatagcacaaactagaaatagctcaaatgtccatcagctgtatgaatataccagaatttgttttatctatttgttgaatagcatcagaacatttgaatagacaaaacaaattctggtacattcatacagtggaatactactcagcagtgtaaaggaatgtacaattgataacatacagtaaaatggataaatctcgaaactaagtgctaaatgagagaagccagagagaaaagtacatatgtaattatgctaatatgaagatctagaactggcgagacttacctacagtaatagaaatcagatcagtggttgttggatattatgggtaagggaaattgagaaagggcctagggataattttgcggtgataaaaatgttctgtcttttttaaggcagtggttacatggttcttgtcaaatctcactggattacaaacttaatatgttttttattgtatgtaaattatcagtaaagttgatttcaaaataaaagtgaagctctaaaaagctgaagggaagctctgtgtttgtggacagcgtttgtcaattagtgggcttcactgtaagatgatcatgtagctagatgagatttctatttctctagaaaaagattctttaatccacagtggagactaggagctggagttagtaagcctggtttttggtgacctgggcctcctttattttcaatcctttaccaccgtctttgtctgatgcccctgatgttggtgcttttctgtttcagttttttcctcccagcacatcaactttctatcttcagcagggtgaaagagggatgatttctgagcttgtggagtgggggtatggagacctaactattctcttacagactttcaaacagtccccctatgtttaatcctctaccctactccattttctgtggtacctgctaccaacaaaccttggctttctttgggttgtgcagggtatgaactggtttgcttgtcatcagtaagctgtcatttaccattcctacttctcttttctgtcttcatctggagttacaggtgtctcctaggtttttgaagatggagtttgcattcctgtttctcattcttattatttggaggagactttaaaactgtgaaacccatactgcacattttcagcgttaccaataccagactccttatacctctctaaacacaccagcctttttctgtctctgtgccttcatagaattcctttttgcttacaaggcgcagtccaacctgtttttacctgataaggctcttatctttcaaaaatccagttcctctccatcctaacttatctgctgcttctaaacctttgttttacagcagatcttcttcattaggaactgccatatagcagtttattgtggagctttccagaggcactggaaagtatgtgttagagtaatcgtaatctgcttaaagtggtggtaatagtaagtgcttgataaatatctgttgaatgaactctaaagatgcatatgaaacactcacccagaaattaggaaaacagactctggccctttgtggagatgaaaggaccagcagagaccaaaagcctgggggggtggggctggcagcatgccacagacctgaggtgcataaatatacacattcagaacaattatgattttgcaagtagtctgttgtattaggggtataaagcagactataacagatgtttagactgaaaatttttctcatattttatctcatctaagattataaaactcattatttcatatgccattaagaaaaaactctattgattatgatagagtgcttatcctctagaactttttttactcattgaaagagttctatgagacttacgttgacagatttttttttttttttttttttttttgagatgaagtctgtctctgttgcccagactggagtgcaatggcacgatctcggctcactgcagccttagactcactgcagcctctgcctcccgggttcctttaattctcctgcctcagcctcccaagttagctgggattacgggcacacaccaccatgcccagctaatttttgtatttttagtagagatggggtctcaccatgttggccaggttgattgtgaactcctgacctcaggcagtctgcccaccttggcctcccaaagtgctaggattataggcatgagccaccacacctggcctgatggatatttttaactatatatcactcttgtgcatatataaataaaatacagtggaaataattggctaaaatatttctagaatttcatctattcggattcagactctttaaaatcacttttcaatttagagccaccgatgtttatactttctttctctgccatccagagtgtttggtgatgacgcatttcttaaaagagtgttctgctatgatctttgggaattttctgccaagttattctgcatgtttttttacaatggtgttttcttgaccttactagagtgcgttcaataaatgacaaccatgtcacagttctgcctgaccaatagggattttaagatgctaccaactataagatgtatttccatttaagtgatgttaaaatgtccaaaaaaaaatgtattttagaattgaaaaatactgtagctcaataattaatgtgattctggcctcagaaactttctctttgttcctgttatttaaaggctgctgctttgtaaaaatgtatttataaccaaacttttcttctaaactgtcatttttgtgaaaatttttaaggttttcttttctactttgaagttttcttgtcttcacatttttttgcttaaagttagcagaggcacttttatttctatcaacttttaaaagaagcctgatgaaaaaatagaccttctacatctcaaatgatttaatgaagtgtccactgatatgtagagagaaatatttgttggttaatctaacagagttaaagcttattgcacaaacagatgtcatcctagtggaagatatttagtaaattgctaaggaactttttctctcctttgctccttcttgatcagcattatttaatcaataaacatattacttcatacttctttttgtattctggccttcacgagaagccctagatcaagctagtcatttgtaccatctctacttctacatcagtcctgctcagtgtttcaggatctatccttacttttgcctgttcctaatcagatacctccttattttcattaacatctatttcagattttcactatcttcccaaattccttaatacctctcctgccccctaaactttaatcaataattttgctttcagtttcactgagaaaaattgaacctgtcatggaaaaaaattccttgtatttttcttcttccatttataaactggtttctttccccctgcctcactaggaaaggtatccaccttcctctgagactaatcccctcaccagggctttggctactagttcctgggtcctcaaagctttttctggatctttcccttcaacatgtacacaagctcaaatatcttctgtcctttaagaaaaaattcatatctccattctcttctagctgccgttttatagccctccttttcttagcaaaaaaactaatggaaaatctagtctacctacaccactttttttgacaccaagtccctgaaattgcacgtgataaggataccagcaaccttcatattggcaaatccagttttttgtttttcctggacctcttagtaacatccagtgctagtgacctccatttggaaagtcccttcttcagcctccataaaactgctttctcctggttttcttgttatctttttctctttcttcttagactccctctaagaattctgttcctctcttcaacccagaaatgtcattgatcctcaacttttcctcagtccagagctcccctcactttatgcactcaccctgagtaaattctcagagctgcgtctccaacccagatctttctgctgacctccaggtttttgtgttcacatttcattcagtcatcaccacttagatattccacaggtacctcctcaaacaacacattcagaaaataactttatctgtcctgtggccaccccctgtaaaacaaaaacaaaaagtctgttttaggattagcaacacaagtctcccagtacttaagccagaaatccaagattcctccctgtcactttcccctcctgctgttctatggattcttcctcctgggctaatcagtgccctcctctttgttattactgtcacctacttggtttagattctcatcacttcttgcatggattattatcataacctcctaatcgatttctaggtcttcagtctggttcctatctatcctccactcaggtgctacagtgatctttctgtaacaaatttcatcgtgttactcttactctctagcctaaaagtctttgtttttctcatagctttcagaataaagttcagactccttagtttagcatacaaaggccaactgtgattggcttttgctgctgctgctgctctgttttcctgccctcttgcttgtctctatacgcccgccagtgaaactggctggaactacttgtacttcggcattcactgtgcagtgttctgcctctctgccttcacatatgtgtttccctctacctggagtattcttcccttcctttttgtctaagtagctctcattgatccttcaaaattatgtacctacatcgctatatttcaggaaacttttcctgactcctcagtctgattcagatgctccctctcaaaacagacaaaggacatgaagaaaggcttcacaagtgaacaatgacaaaatgtctaataggtaaatgagaagatattcagacttaccagcaatcaaggaaatgaagattaaaacaatgtacttccatttttttcatcaatcaaattaccaaaaatttaaagagaggaatcagtccaagaaaacatggagaaacaggccctcttctagattggccctatgtatctaatgactttttttgaaaaagtatatgtacacacacacacacatcttttgactcaacattttactgtgtggaatatattataagcaaataactggagagctatgtaaaatatatgtaaaagaatgtttatcactgcttatttgaaaacaaatagtaaataacctaaatgttcagcaataacaaatggctaaatttatttatatgatagaatgttattcattaaaatgatctatgtctattttgacctggaagtacatttgtgagatattgtcaaagtaagttatagtatggtccaaattttgtaaaaaatacatacatttataaatttttgtaagagaaagttaaagtatatacataagaatatcaacagtgtttatttctgcttgtgaatattgtccagcttttctgaaaagaacatttattaattgggggagcaaaatgggagaaacttggcctcactcccaatagctgctgtgcttgcttgcttctgtcactgccctcattaaacattgagcactccgaagacatcactatatgtcatttggcatcattctcccagggtcaggcacagagtaggaaatgtttgataagtgaattagagcaataacagcaataatatttattgtgcatttactgagtcttaggtactgttgtaagcatctgacatatgttaacttaatcttcatgagatgggtattattattctctccattttgccgttgaaacagactgacaaggttaaccaccttatattaggccacactggcaggattgggcttcaaaaccatggagtctagctttctcttagacgcaggactgcatggtgcttctgagttaggttggatctctgattgaaaatagtggattagattccatgtctaagattccatctagttaactgggcatcaattgaattatggtctgaataaaaaggcagaatttgacacccatgggtctgaaacaaatagcagggaaagtaatctttgattctttggcattttttttttaactcaaatgattttagactgtaaatttctcattgatagttggtgctaccccttgaggtttggttttctgctgttgatgtcctttcaaaacttactcaaagacctaaatttgtgattcgttcttttaagtcttgccccatcccctttttctttctcagcaagatgactcgtgaaaagttcatcagatttttatttatttacttatttttatttttatttttttctgagatggagtctcgctctgtcacccaggctggagtgcagtggcgtgatctcggctcactgcaacctctgcctcccgggttcaagacattctcctgcctcagcctcccgagtagctgggactacaggccatgtcatctcccacattgtctccttgctttctctgctccacccactttggtcactttgccattcttttagtgaatcacgcatgctccactctagggcctttgtacttgcggttattctaccctggaggatttacctcataatacctccttggcctccttcctctagtctttcaggtctctgcttttcagatgtcagtgaggtcttctctgacaacccttcataaaacagcaccctcccagcatttctaaacccttgccctgcatcatttttctccccaacacatgccaccatatgataagtttatatgtttaacttgtatgttgggttttttccccttgttttatttcctgctctatccctagtgtatacaaagaacctggtacacacagtaggtagtcagtatttgttgacggaataaatacattgacagaaccttcttggaaagcaactacagtatattttaaaagctgttctttaaaaagaatgattaagtaaattctgtccacttgatgcagagagagagatatccacatggagcagggtctgggagatgggatcaagatcagtaatgaaacttgtgttttctttcagtaagcaaaaagaagatgatgggagaataatttctaggagtagaggaagtttgagactcaagaacaggtactaggtgttggtagtctttgagaagactaggttgatggaagcaaaaggttggtgcagggacatagtagaaaatatgattatagatggattggaacaggtgttgagggacttaaaagtgagtcaaaagaggtagacttgctgtgatccatgaggaaatcagaagtgtgaatttttaagctgtgagggatgaaaatgccgtgtaaatctaagcttcttaatatcatataaggtggcaaggagcatgcaataagaaattcatctcagaggcagatgtgacaaggcagagttgaggtaatattactctaggcaataaggagtataaggtgtgatgaaacaaaggcatgagttgaatatcagctgtaagggatattgcagataataaagcgtggtggttaactgcaaatgggatgcaaagaaagaggaaatcaaaagttccagcattaaaaaaatttccttttaatttttttttttattacaggtttctctgtcattcacagaaaaatgaatcatttaaacctttggaggactcagttatcacaatacttctctactaccaactaagatttatgatagtaaatttatgagagcaaatttccatgttatagaactgttgaagaactaaaagaggatattctttcatcaaaataattctgcagtatcataatattactaaataaaattaaaaagcacaattattaaattattaaatttgccacacatgtgcagcagctactgtatcctgatagtgaccaaacctcaaatataaatggtttcccttcatgggaaaagccattatatttggaagaaaccactgaacattgttattaaatatattttcagctaactgtcatttaggagaattttcatgaaacaagttctagaaagttccaagtcccaccagtaagtggatttgatattatggcagcaacttacagacttgtggttagtactgtgaaccactacagcagcgtggtgatagaccggcgttttgaacaagctatacattattgcactggaacctgccacaccttcacacatggaattgactgcattgtggtacaccatagtgtttgtgcagacctcttgcacatccctgtgtctcagttcaaagatgcagatctgaactctatgtttctaccccatgaaaatgggctttcttcggctgaaggagactatccccaacaggccttcacaggcatacccagggtcaagagaggatctacatttcagaatacctacaacttaaaggatattgcaggagaagcaatcagttttgccagtgggaaaataaaagaattttcctttgaaaaactcaaaaactctaaccatgcagcttacagaaagggaaggaaagttaagtctgactcatttaataggaggtcagttgatttggacttgctttgtggccattataacaacgatgggaacgccccatcctttggtttactgcggagttcctcagttgaggaaaaacctttgtctcatagaaactcactggatacgaacctgacttccatgtttcttcaaaacttttctgaagaagacttggttactcagattttggaaaaacataaaatagataatttttcttctgggacagacataaagatgtgcttggacatcttattgaaatgctccgaggatttaaaaaaatgcacagacatcataaaacaatgcataaagaaaaaatcagggagtagcatcagtgaaggaagtggtaatgatacaatttctagctctgaaactgtctatatgaatgtaatgaccaggttagcatcctatctgaaaaagttaccatttgaattcatgcagtctgggaataatgaggctctagatttaacagaactgatcagtaatatgcctagcttacaactgactcccttctccccagtgtttggcactgaacaaccccctaaatatgaagatgttgtccagctctcagcttctgactctggacgatttcaaactattgaattgcaaaatgacaagcctaattctaggaagatggacactgtacaatccattccaaacaactccacaaattccttatataacttagaggtaaatgatcctagaactctaaaagctgtccaggtccaatcacagtcattaaccatgaatcctttagaaaatgtttcttctgacgacttaatggaaactctttatattgaagaagagtcagatggaaagaaagcattagataaaggacaaaagacagagaatggacctagtcatgagttattaaaggtaaatgaacatagagcagaatttccagaacatgctactcatcttaaaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaaggtaagacccaacaattttgagtcctaggaactctttaaaaaatgtttagtgtttgaaaattttataaagaaaaacttttttgttagccattttttgttctactaaagctctgccctacactaggaatgatctcactcagctcagagtcagtaaaaagcaaagattatacaagatgatagaggaaaaaaaaaaagcaaagactttagactcagactggttcctactgccctccccatacccttcatcttcttcccagctctgtgaccaaagaaaaattacttacctttaatatcctcatctttatggtggaaataataaggatcaaaataacttgtgtgaaacataagcaaggttccttacacaaagtaggcatttaatattagtcgtcaccctccccagccaaccaagagaccagttgttactgcatgcctgtgtagacctgtgtaaggttagtgtagagtacaaaaggagagaagacatgattctttaagagcttaaaatccacttgtagagacaaaactgacaatgtctgaaacagttcatgagcatgtgaacaccattctgaaagtattgtcataacagtaggccttcaaagaagataaagactaaagggtaagatttgattctccaggcaactgagaataaatatcaatctagaatcacggaagtattttcaaaagtttttaatccatccccctactgaaagcactgcttttgaatactcccagaaaggcagttgtcttcccattttatttacatacgtgtgtcgtagcacaacaagattattccttgttcgttttataagtccaacatgggttagcaagaggctctgctctacttcattcaaggacccagtctgatggaggctccatgttcttactgctgcccattgacccatctaggatatgtggcttttgagttcactgaaggaggggaacaaaggggtgatgcttttaactgccttgtcccaaacttggacacacttcatttctgttcacagtccagtgattcccaacctaaaatctaagaaacatagaaaagcacatggaatatttgttaagcactgcccctaccacatgaatgagctatatgtatcaacatgtatgaattcagacataaagccaaatcgacaaaagcaagttgtaaaataaggatatgaatcattttgagatacatacatttttacaaaaagtatgaagaaatacatggatacacaaaatccaatgttaatggttaatcctggaggaagggaaatgcaactgaggaagggcgtacagggggcctgaatagtattagtcatattttacttcataatctgggtagtagatctgtaagtattttgtcatgttattctttgtgcttttttatattcttaaatattacgtagtaattttttaaaaaactaattggatatttgagatgccatttatgtggccaagttaaaatacaagttacatattaggcttctcattacaactgtcatttgagcaggggaacaaatgcatattgtcatcagatgaatctttctttccctggtacatgttgagcatccaaaatccaaagtgctccaaaatttgaaactttttgggcaccaacatgatgccacaagtggaaaattctgcacctgaccttgtgacaggtcacagtcaaaacgctatcaaaaccttgtttcacgtacaaaattctttaaaatactgtgtaaaattaccttcaagctatgtgtatatatgaaacaaataaatttcgtgtttagacttgggccccatccccaaggtatcccattatgtatatgcagatattccaaaatccaaaaaaattctaaatctaaaacacttctagtcatgagcattttgaataagggatactcagtctgtatgttttgtggctgctattcttctgtggacttttttagtcactagcaacactaaagtttaaaacaatacatacttttaataaggttactaagtgattatttgggtctaaatatcacagatgttccctgagcatttctgtgaaattactttgtgtgaatctcctcatttgttggttcacaggtggtagtatctttagtttggggtcaacactaggggagaaacttggaattaatcacaaaagtaagaaaaatcccttcacatggttttttttcccacatgacacattgcagtacacaggcaatactgatgtgcttaatagtttattataaaggaaagaaaatacctacatagcaacttcaaaatgataataatgtcataagagctaccagttattgtgaactaaggcatactaagacatttaaaggtattatctcactattttccctcacaataacctgtctgcccattgaagaaacatctgctttctctgatgacctattccaatatcttaaaaccattataaccagaaactctcactgtgatacggtgttttgaattttactcaaccctcttcccccattatcttctgtgacaaaaaggagacaaattctctaaaaagagatggactgcataaagtagaaaatgtctgagcatcacctgtcctgtgttcctggctaacacctcatgagtgggttccccgtgacccccaatctaggtacagctaccttaaaatgccacactgggctctaaatgtgcttcccacttttttgacaagtaatggactgaaatcagaatcttattaaaagattgtctcctgccattcttttaaataagtttcaatatcacagaatataataaaatttgatgagatttcttcttgataaaagttggaaaagtacttaatgaaaagctaattcaaagagacaggtaatataaaatgtttaattcaggaagatgcttaatgcaagaagacaaaccattcttccttgactcagttgccttcctacttgtctttttttaatctttcttttcttatgaaaagtttaagtgaggaattggcaaacatttctatgaagagcaagatagtaaatattttaggctttatgggtcagagtctctgtcatgtagtcttatttgccctttgcaagacaaaccaacaaacaaacaacccagtgctttaaaaatgtaaaccattcttagctccaagacttagaaaaacaggcagtgggccagatttggtccatggactgaagtttgtcaacccatcttaagcaaatagaaaagtatggtgaatgatacaaaagcactgttatcacccaccatttagctttgtcaaatcttaacattttactgtttgcttcaaatcttctccaaataccttttgtcccaggggaattcagcaagagactatatagatatatatgaatccattatttctctcaaacctaagctctgtaatagttttatcttgatgatcaagggcaacaaaaattgttctaacagaactttccttcctagagaatataaagggaaattgcagactgctctgcttatattattatgaattccaagttagtagaatccacaccaataagggatagagagtaagaagcctacctgtccttcaggtggtaaccttttcccatcggttttctggagtttaaagtcagaatttaagcaggcagtctgcctgacaacctaattcacatctgatcttctctttttccattcagcctccaaaaatgttatctcaagctctcaaatgtatccgaggtaaaaatgaaatagtgaaataagaatatggaaggagatgtgtgaatctctcttaagtttccacatctgggctactagcctctgttggcctttatttagcattaaatagctatttgttgaatgaataaatgagtaagtggatgaataaccaagtgaggggatgttcactttcctgctttgtctcctcaaatggaaaccgctcccttgcctgagggccatccctttccctgctttttgcttctcaaggatgggtacaagaggacctgacatcagggtgcccttctcagacttcagggtagtgcctcagcaagactcaagtatcttacctagacctctaagtcttttaattcctctagcctttaacacctaaaaaacgacagtaccctaggaagggtctggtcacctttcctggcaagagggaaagacatcatgtgagtgtagattgttttactttattgtgggggcagaaatccctcgataatatgctgtagccattttgaggagagggtgctttctcgatcaccattgttcccacaggctttcttacagtacgctatatacaagctctttgtttaaattttgaaaattttgtaacaatttactttctctttaaggaatacctatatattcattgtccttttgcccattcttagaagttgccatcttcctcctcatggatttgggttggaaaaggatatttctggccgtttaattttagtacaattgtttgtttatttgtttttggatgcccgagagaaatctttgaaggtgagcataatttctgttgttactagaactcactttgctttcttctaaccctgagcaggaatttgtatttgagatttcattccagaggaaataaagaaccttcctatgttaatgatctaacatttaggtttcctcattgtttagatagtatagtgtatagttttatatgcatatttgaatgcagaataattaggaaaataaatttaacattttagcaaagcacattttaggaactttgttaaacgttccttgtggagccttaataaacacttttctctctttactttctaggtttatatccatgccttcattaacattagccagtcatgtcactgagggaaaatgtttcttccctggctttgtaggtgctcatggtgcctggattcagtgctgggaatgcttaagtagaaatcaagacacttagcaatacaataggaaaccattctctcctcctctcaattgccaccaagcagattaataaaagtaaacacatctgcctggtggcaaataggaatttgtggaatgagcccaacctgaatatccccctccacatttggtggcttctgacgtcaggtacctttgcattaatacctgcattctttctgattaacatcaggtatctcaaatatgtccccacctatgttcacaagagcctggtagatatatatgtactgatgtagaagggtcaagataaagttaaaaatgtaaattgcaagatgtaccattatgatccctttttgttattaatatatttttatgcacacaaagtttggggtacatatgctcaatattattcatgttcctccagaagtagaaagtgaatctcatatccaggtgttcctgataagtctgccctctcccagcctccactccacccttggcaggagtgaagaggagctcccagaacccagcttgctccattaagcccacaggcctgtccaaccctcacagcttcaccaccactctctgacttaaggtcatcaggactaatctgtctaatatgcccttcatccttgtttacattagtcaccaccagaaatccaggaatccagatcaccccccatcccccaccccactttcctcctcacactgctcttatatatttcctaagtccacttccaaccctcccaactcctgaaatcgtttcaccatgtcctcttgcactctgaattcatgatgatttaccggcaaagtttcctatgtcatatctcttctctaaacatttcccttcctattataacttaaactcgtctcttcctaaggatactgtagccagtgaaatggtggctctattctttctcattcccaccccctatcccactgggcctggagggggcagtaagggttcttgcatttcattgctgctctagactattctcctggctgcctccctgaaaccagccccgccccaactttgaactaataccattagactctgctatccactacctcttctgattgtagtcatctaccaacccaggtcacttatttcttgaaggttttatctcctggctttatgacacacttttcaatattactcttgccactgttcgagtgtttgatagataaggtatccaatacaggagcttctcaattccttgatctcctctaatgagtctgtcctctgcccttcttcgttcattttctggccttatgtttatgtcagtggttttaagagtatggttcccaactaatactgttagcattacctggacacttgatagaaatgcatattctcctaccccaacccaaacctagtaaatcagaaactctgggggtagggctcaacattttttggttttaacaagccctccgggtgattctgatgcatgattatgcttgagaaccactgccataattcgtcactaaaatcattcccttgaatatactctgaggttccttgtcatcccctcatttcatggtacccacctggaacagctccaactcagattaaattgtgttctctgtctactttgagcttttattcgtgcagctgaacttggctacagaagatcacacaaccatgctgagtggtcttgctttaaattcatgaccaccaacctccagtgggtctttagtactgtgtggcagtcctactgtgtttccctagtccattcactttccactctgcaggtgcctttttccctgtcttctaacctccagcatctttcccatcctcaccctcagctaatcttgtttcctattttactgagacaactaaagcaatcagaagagacctttatccatctcctacccatatcagtactaaatatcttctccctttccttctatttctattatttctatacatgaaccatccaagctcctgtctttttcttttctttctttcttttttttttttttttttgaggtggagtctcactctattgcccaggctggagtgcagtggtgtgatcttggctcactgtaacctctgcctccctcgattctcctgcctcagcctcccgagcagctgggactacaggcgcatgccatcacgctcggctaatttttttttttttttttttttttttttgagacggagtctcgctctgtcgcccaggctggagtgcagtggcgggatctcggctcactgcaagctccgcctcccgggttcacaccatactcctgcctcagcctcccaagtagctgggactacaggcgcccgccactacgcccggctaattttttgtatttttagtagagacggagtttcaccatgttggtcaggctggtcttgaactcctgagcttgtgatccgcccacctcggcctcccagagtgctgggattacaggcgtgagccaccgcgcccatccccaaactcctgtctaaggccagacctacactggggctttattaatagataccatcccctcccatcaactcacaaacactcctgcagagattgacccatttctcccctgcagtcatcagtttttctcctctgctcaatcactccttcagcagataaacatgctacaattctcccagctttaaaacaaaacagacccctagtgctccaacataccagttgagttaacactcatttgtctgctcttcttcactccagggctctctgaaagagctgttattattgtttccagttcctcctctagccctcctctttctaaatataccagacatattcccatttgctgttccttcttcctacaacacccccaccccatacctgcaggactcactccatcaccacatccgtctttgtaaaaatatcacttcactgaggcctttttgccctaaaaatttcatgcacacatacaatctttggcattccctttccccctctactgtttttttttcccctaacacttatcaccccctgatatattatttcaattactgtttctttttctccactgactcctaccactagaatgaaacctctatgagaacagggaattttatctgttacattcactgctatatccctggtagctggcactcagtgttcaattgatatttgttagtaattgtcactttgtatagggacttttgtttctatgttatatttctgtagtatttaaatttttccttacaaccaaccttatccttttgtaagaagaaaaaaataataaaggtaatttttctaaattctcttagataccctaagagattccactattttagccaggcttgagcccctgaaaccaggcttcccaatatgatcatcttcagaaattggataaaattacgtgtgtaaactgatcacttcagaagctctattataccatatcttgcagtccttcataagaactgggaattacatagagatctttgaatcagtcatctcccttgagattgccagcaaaccgtaactagtctagccttggtctgaggagttattctgtcatcccctctcatggatctacttttggagaccacagttaaggtgtttaccctgggaggtgctttggcatccaagagacgtatttgtcgtacttccagcataatgctcattgtcaccagcgtccttgactatcagttccaagctcctgttttgacatctgtgagttcaactcccacccacaattactgagaaatcatacacacacacacacacacatacacacacacacacacacactctccaccaaggaagacactggggcagagtattttatagcaccagtcaccaggcatttatttaacatggcagtgtcagtgaaatagaatcccttcatttcttttttctccaacatatttataggccaaaaatgaattattatggtctgtaatgagcaatctctaattgaattaattcctcaaggagagagggaagaaaaaaagcagactaagaagtacagagaactctagacactagaaattctagggatcccagaattattattcctgatcattttaggctctaattcttccttgctgccccagatcctagaacaacatctaccccaagtattaggaacactgaaaagcaaaaacaccagattttgtgggttctttctgttattagtcatagaatgtgttcccataatttggaggcaattggagcaagacacaaaaatgcttattaggtttcctctatcatacacatgctttcctattttgctgcagccagtgaagtcaaggctagagaattaggctgggaacaaataaactatagataactaccactacctggcctcctttcccccaccagtgtttcattatttaagagtgaaaaaaaaaatagtaacacagaacaagccactaaataatgaagaaaacaccaagttagagcagaaaggttatgaaatctagtattaactaattagcttataatcagttggctctcataaggcctatttacagggatattttaaagaaagtctgtgattccaagctgttaacccttttgatttattttctatttatttttatttcaataggttttgggggcacaggtggtatttgattacatggataagttctttagtggtgatttctgagattttggtgcacccatcacctgagaagtgtatactgtgcctaatgtatagtcttttatccctcacccccttcccacccttcctcccaagtccccgaagtccattctgtcattcttatgcctttgcatcctcatagcttagctctagcttataagtgagaacatacgagtttggctttccattcctgagttacttcacctacaatagtagtctccaattccatccaggtttctgcgaatgccattatttcattagtttttatggctgaatagtattccatggtgtgtgtgtgtgtgtgtgtgtgtgtatgtatgtatgtatgtatgtatgtatgtatgtatgtatgtatgtatcacattttgtttatccactcattgattgatgagcatttgggctggttccatagttttgcaattgcaaattgtgctgctataaacgtgagtgtgcaagtatctttttcatataatgacttctcttcctctgggtagatacccagtagtgggattgctggatcaaatggtagatctactttcagttctttaaggaattttcatactgttttccagattgattgtactagtttacattcccaccagcagtgtaaaaatgttcccttatcaccaccatgccaatatctactattttttgattttttaaattatggccattcttgcaggagtaaggtggtatcgcattgtggttttgatttgcattttgctgatcgttagtgatgttgagcattttttcatatatttgttggccatttgtacgtcttcttttaagacttgtcttatttgtgtccttagcccactttctgatgggattgtttggttttttcttgctgatttgttttgagttctgtgtagattctggatattagtcctttgtcagatgcatagtttacaaagattttcttccacgctgtggtttgttatttcttttgctgtgcagaagctttttagtttaagtaagtcccatctatttatctctgtttctgttgcatttgcttttgggtccttggtcatgaagtcttcacctaagccgatgtctagaagggtttttccgatgttgtcttctagagtttttatggtttcaggtcttagatttaagtccttgatccatcttgagttgatttttgtgtaagatgagaaatgaggatccagcttcattcttctgcatgtgatttgccagttattccagcactatttgttgaatagggtgtcctttccccactttatgtttttatttgccttgtcaaggatcagttggttgtaagtatttggctttatttctgggttctccattctgttccattggtctatgtgcctattttggtgactatagcgatatagtatagtttgaagtcaggtaatgtgatgcctccagatttgttcttttgcttagtcttgctttggctatgtgggctcttttttggttccatataaatttcaggattgttttttctagttttgtgaagagggatggtggtattttgactggaattgcattgaatatgtagattgcttttggcagaatggtcattttcacaatattgatcctacccacccatccatgagcatgcgatatgtttccatttgtttatgtcatctatgatttttttggcagtgttttgtggttttccttgcagaggtctttcacctcctcggttaggtatattcttatgtattttatttattttgtttttttacagttattgtaaaaggggttgagttcttgatttgattctcagcttggtctcagttggtgtatagcagtgctactgatttgtgtactttgattttatatcctgaaacttgactgaattcctttatcagatctaggagcttttggatgagtctttagggttttccaggtatatgatcatatcagcaaacagcgacagtttgacttcttctttacctatttggatgccctttatttctttctcttgcctgattgctctgactaggacttccagtactatgttgaatagaagtggtgaaagtgggcatccttgtcttgttccactgctcagggggagtcctttcaacttttccttgttcagtataatgttggctatgggtttgtcatagatagcttttattaccttaaggtatatcccttctatgccgattttgctgaggttttaatcataaagggatgctggattttgtcaaatgcttttcccgcatctatttgaaatgatcatgtgatttttgttttttattctttttctgtggtgtatcacatttattgacttgtgtatattaagtaatccctgcatccctggtatgaaacccacttgatcatggtggattatctttttaataggctgttggattcagttagctagtattttgttgaagatttttgcatctatgttcaccagagatattggtctgtagtttttttatgtcctttcctggttttgatattagggtgatactggcttcatagaatgatttagggaggattccctctttctctatattttggaatagtttcaataggattggtaccaattctttgaatgtctgatagaattcagctgtgaatccatctggtcctggacttttttttgttggcaatttttttttattaccatttcactctctctgcttgttattggtctgttgagcttctgtttcttcctagtttaatctaggagggttgtatatttccaggaatttatccatctcttctaggtttttcagtttgcgtgcatgaaggtgttcatagtagccttgaatgatcttttgtatttttgtggtatcagttgtaatatttcctgtttcatttctaattgagcttatttggatcgtctctcttcttttctcggttaatctctctaatggtctatcaattttgtttatattttcaaagaaccagctttttgtttcatttctcttttgcattttttgttgttgtttgaatttcatttagttctgctctgatctttgttatttcttttcttttgctaggtttgggtttggtttgttgttgtttctctagttccttgcggtatgaccttagattgtctatttgtggtctttcagactttttgatgcaggcatttaatgctatgaactttaatcttagcaccacttttgctgtatccccgaggttttgataggttgtgtcactattattgtctggctcaaagaattttttaatttccatcttgatttcattgttgactcaacaatcattcagaagcagattatttaatttccatgtatttgcatggttttgagggttccttttggagtcgatttccaattttattccactttggtctgagaaagtacttgatataatttcagttttcttaagttactgagacttgttttgtggcctatcatatggtctgtcttggagaatgttccatgtgctgatgaacagaatgtatattctgcagttgttgggtagaatattctataagtatccatttagtccatttgttctagggtatagtttaagtccattgtttgtttgttgacctcctgatgtgatgacctgtctagtgcattcagtgcagtattaaagtcccccactattattgtgttgctatctgtctcctttcttaggtctagtagtaattgttttataaatttgggagctccagtgtcaggtgcatatatatttaggattgtgatattttccactagtccttttatcattatataatgtccctctttgtcttttttaactgttgtcgctttaaagtctgttttatctgatataagaatagctactcctgctcacttttggtgtccatttgcatggattatctttttccacccctttaccttaagtctctgtgagtccttatacgttaggtgagtctcttaaagacagcagatacttggttggtaaattcttatccattctaccattctgcatcttttaagtggagcatttaggccatttacattcaacattactattgccatgtgaggtactattctattcatcatattagttgttgcctgaataccttgggggttttttcattgtgttattattttatatgccgtgtgaaatgtatgctttaaggaggttctattttggtgtatttcgaggttttgtttcaagatttagaacttgttttagcagttcttgtaatgcaggcttggtagtggtgaattctctcagcattggtttgtctgaaaaagactttatctttctttcatttatgaagcttagtttagttggatacaaaattcttggttgataattgtttgtttaaggaggctaaagatatgaccccaatcccttctagctagtagggtttctgctgagaaatctgctgttaatctgagaggtttttctttaaaagttacctgatgcttttacctcacagctcttaggattttttccttcatgttgactttagataacctgatgactgtgcctaggcgatgatctttttgcaatgaatttctcaggtgatttggatatctagatctctagcaacgccagggaagttttccttgattattcactctgttattacctttttaaactactcagcctgttagaactacaacatgagaaggctttttaaaaattgagataaaattcattttctggacatttgggttgtttccactttttggcaattatgaatgatgcagctgtgaacatttgtgtataagtttttgtgtggacaaggacaggctgttaacgtatttagatttttccaaacagctggctggcttttgttaatcagaagcaccctcatgatataccaggacctccactttgatatgtaactttttttctgtagcatcttctgagcaaaatcctttggtgtcacttcagagtgactctctgtctttggtgtcacttcagagtgactatgctatctttctggacctgcttctaacactaacctcaatacaggtcctcacttagctgagctgatttcccagcctcactgtgctatgtttctgtcatccagatttttatagctttgctgcctgcattattccaactgcctttcctactctaaggccttagctgatgctatcatctcagtctccataaccacattcagctgagactgttgaatggatttacatgtttatatataaaataaagggctaggccaggcacagtggctcacacctgtaatcccagcactttgagaggctgaggtgggcagattgcttgagcccaggagttcaggaccagcctgggcaacatggcgaaaccctgtctctactaaaaatacaaaaattagctgggcacagtgccatgtgcctgtagtcccagctactcagcaggctgatgtgggagaatagtttgagccagggaggtggaggttgcagtgagccaagatcatgccactgcactccagcctggacaacagaggaagaccctgtctcaaaaaaataaaggggtagacttactttggtacaacacattgcatatataatactgttttttaacagttatacacaaatcaaaataagagacttcttcagacaaatgttcaaaattattttctttgtcctgtgtaatcaacccattttttcttaaaacatcccatgtagctgatttccccagaaaaaaagaatattataaatcactattgtcttcgttttcaaagggggaagggcaaggaataataagagggttcagaaagttctaagaaatctgtcttggatttcaaactaagcctaacagaatgaattgtataaatacagaatgtgttgtgtttcacagttttattctctgtttcctacccaatctcaccttccttcagggtacattttaaacttattcctcagttttgtaggtcctttcagtatagggtaagggagcatcttttctcgcttgggatattagaggctatcctaaaaaagaaaaaaaatatttagtttttagggtcatagtggagaggccagcttctcttccatataactctgccagagggaacctgtaaaactcatgcccagcagcctatcctacccggttctttttgagaaagactgtctcccttgcccaggcatgcttgttctggagaaagatatatggaatggtaaggcaggaaaggaaccccagacccagaccaagacagctggatctcaaattaacaactgatgtgttccagccacccccacagcagagagcaccagtcttttgcctaatgaagctctcttatcgttgtcatcctgaagactcagattgagcacatggtccagataggactgcctgtgtcttcagacagggaaagttcatgagtgatctgcaggccaagaagagatgcaggcagctgtgcaggaagttcctactggtggtaatcagctagcttgttaggatggacttaattatatgctgcagggagcaggagaaaatattttttagtttattccagaaagacatttggaaaacttttacagtggctctttccattgtaactgcacacagctcctaattttccacgtgctcaaacttaatttataacctatgtgtttatgattctctatttttcctcattctggttagttcctccaggagaaatctgtcaccccaaaacagcttttctcttataattcccagccccatagattgtacattcccttgtcatcaaagcagagagagaagagagtagatcacagatcatatatttctctgtagtgaaattcccctatgtttgatcttttcctggaaagtcactctaaaaaccatattctttggtgctatattccagttgtcatgaactccttgaaactaactcgtgttctcagatcctctcagaaaccaagcatatatactaatacttccattcaaacacaagtaaataagtaaaaagcaaataaaccaacttcatgctagtcttcctctgtcaataactcattgccacagaccagttcttttctaagccctttagggatcctggtctttttgcctctgaattttttggaaaacattttgatatatcaaaacttaccaattatttcctcatcaaaagacatgaagaaatattttcttgcttaagggtataacaacagggcaggcttttaaccactgttctgactttgaaacttagcagatttataggaagtaaatgaaatgaaaatatttcttgtcctttgctccaaaccaacattgtgctagaaagcacagtaagaaagagaccacatctttatcatctctctagcttcatatcaagcaaagtgtctggcatataagtgattatatataaaaatatttgttgagtaattgaatgactataaaattaaaatctaaactcttgtcctcaagagtttagacactactggaaaataatgatcaagttacaaaatattacagtagaagcccttttacctgaacatgattgagtttgatagtagggaatcataaactatatgtgtgtgtactataaaatgtctatataaacattttaactcaggcattaatttattctgatgtcttttgatagagggtcaaagccttttttctgagaatgagtctcatacatatttagagttctgtgacatatttctttgataaatcacactcataataggtttgttgtctgatttgtagttttagtttctttagagagagaacatagtagtaaagcaatttgaatgtagacaccttctaaacttcagtgatttttctctttcatcccacccttacctaattttacagcaaaatctttttagtagtttacttttactaaaacttagggtttttttttaattttagaacagcttttcttttccacgcttatattttgttagtttatgtaatgaattgaataattactgtgaaaagtataaccagcataaacagactgaggacaaatgcagctgactcttagtaaacacacaacccaactactaaggtaagaaatatgagagtgtaagagaaactattagccacaaatctgtgtgtgatgggcattagttgctctgtttcagaggagaaatggagagctttggctaaataagataatatgttaagtggagttcctttgagagacgttacatagtatttcactaagtgctgtatatataaagttaagaattacagtaaggggacttaaataaacaggaagccttcatgaaatagctaaattttgagatggatcttgaaagatgattagaatgtataatttgaggaaagggagcattctcaggaaaggaatgaacctactcacctacagccacaggttggtgttgggaaggagaggaaatttaaggtgtggtttaatagaataagcattaaattgtaagtctaaaggcctagttgcattcctacaaacctttttgacattttatttaggagataaataatgagggagaaaaagagtattctagtcgggagtgtaaggaaaaaatatgggaaagctacccacctcaaagaattaacatggaagcccagtgagagagaaaattgagaaaataaggaacgactcaggatgaagcataagaccagtggttttcagttgtaatcctctttcaatcatagtacgtatcaaaagctttcagataaaatttgatgtgaacagaagactctgccacttaaaagaaattctttaaaacacagctttagacatataagcctaatgtatacattagaaagagttgtcagaatgtcttgaaaagaaatcagtgggaaaaagcagacttaaatttgtaggaaacagtggaaaaccaaagaatttaattcccactaaattagacaaaggttcagtaaaagagggttgtaagctatttttttgttttaataatgtttggtgtatattttctagacatagaaaaatattgaatgatgtggttgattgaaaataaatattgaaatctaaatataaaatgtgagaaaacagccctctgtatcaatgtgttctacatctagttggaaaatatttggggaaaaaagtatggttgcatatgtattgaatatgtacagacttttttttcttgtcattatttcctaaacaatagagtataacagctatttacataatacttatattgtattaagtattacaagtaatctagaaatgctttaaagtatatgggagaatgtgagtaggttgtatgcaaatattacacattttatgtaagagacttgagcagctgtggattttggtccgtggagggtcctggaaccaatccccacagttaccaaaggatgactttactttatgattcacttacaaataactatatgaggcagatatttaatatatgatgaaataataggtattttaaaaatcttaactgattaaagcttctcaaaggaagaaaacttacaaattcagtatgtagtatgtcattgctgtttgatcatcttttgtcctttttttagccaaatttcacttgcttatatgtatctaaaacttttctatggcattcagttgttctactttcttaatacttccaagaacaaattttcaaatatgttcatcatcagttcaagaaaatgtttgataactatgatagtcttttgctttaaaaaattttacatctgagatcaacagatctttttgtaaattcccatttgagaatgaaagtttctgtttttcctcttgttttgactagagagatctggaaagatttgggtatttacttcccttcaaataaaaaataaaaaactattcttaatagtttcaaattcgaagttcagtagcctgttcttttttttataaaatattaaagagaaaaagccgaaaatgttctacatactctttttcttctagtttgagaagaaactgctttatgtggattgacacctcacataccctgagtttaagaagttagcattatctgagaaggtactatttttaggtccagctgtaatgtttctaactttggtacacagagtagtgggtgctccctttcccagaaggctccatattctcaacatgtgcaggtcaatttgacataaagctaccaacaaggagcaacaggcccactgcaggctgtgtttataacttgaaaattatgagcaggtattgggagccacagactgtatttgggaaccagctgcatgtcaggacaagcatagattgtggtctgtggaggctgggagagcacaatgcttgaatttcatttctttgggagataagaagaaaaaataccttcctacctgacaagattgacaacttgctaaatctgattatcttcagaagtgtgctggacagttgcgaagtaaacatttacttttcaaagatgatgatcaaggaaacatctctacgaagggacccggatttaaggggagagctagctttcctggcaaggggctgtgattttgttctcccttcacggtttaagaagcggctgaagtcatttcagcagacacaggtttgaaatttgggtgttttgttttgttttgttttgttttgttttgaaaatatttttattactaataaaaccatccagtgaactaactcacaagtaattttacagctcccttgtatcttgatattagatcaaggaattaatgtgtgtcctctattcagctatttgcagaaagctatttgcagagggattccaacaggtttaaaaatagaccttctggacctggagtacagtactcacatttttctcttgtagagagggaatccagttttagagacaacaaatacaacttaatgaacattttacaatttaggtagaaaattaccagaatttttcatagaaatatccttgagaaactagaatttctgtattaaaagccttgtttgcactttgaatcaatagattatatattagcgtgcatacacatctgtaacaaatgtttgtttaaaaagtatgttaatcctggtaatctttttttaaagcaagacgtatttgtctatatagacaattgtgtatgtgtgtgtcgtaatgtatgtagataacaaagactggtggttacttctagatcattaaaaatgtcttccctaagcaagctgtgcaattgagtcatttctgcctatgatgagtactttgcagagtccctactttcttgcttaaaacctatggcagtgtttcaccaaacaagtgcctaacattgactacaatataaatcaaggactgtacaaatgctggccatccaaaatccagcaagaaaccatagttttatggttattctgacccagaataatctcaaattatttgggtaaatatgaaattgcttttttgtaggtcaaaaatgatcaaatattggaaatgctacagtgacataatagcacaaggatactattctgaatgaatatctaaatgatactgtgtttatagggaaagacaaatggagaattgaagtattttacccagctaattctattctaatgctgctcctagactggactgaaaccactgtatccaaagtgagcagatgctaaacttgctagtaaatctggcagaatttatgttactaggttttcttccataatgtttgtaaactaccagttttattcagctactttaaggtttaaattatatatctcctgtagaactcaatagaaagtaaattgagtatccaaaagctcaaaataaatgcattattttaatgttattttccttttaaatattaacatcagttttattaaatatggaattgaccagtggattaatagttgcctatcagtgaattgctctgtgttaagtacactaagaaaagcagaacagaatattttataatcagatattttcccattcaaataaaatctttggcagccagtgttctgaatatcacttatttctgtcaaagcaaaagcatagagttaacattgaagaccttgctgtaaacctttcccactagtatgtattcatgagactctcaggtttcatccctgctggcaccagtggtcttaattctatgggcataactgccctagatgtgacaccacagaaaacattggtgattgtacacctgaacctcacaaatctctttcagcatagaataatggaaaaggaatgacactaatataaatggtctaggtaaagcccctgaagaattctgtgccttactttagaattttaagaacactttgaagaataataataatttattgacttacgggactgtgtaatatttacagatttagcattaaggcagagagaaatgtttattgaaaatggattgtcaatttgttaactcaaaagtggtttgtaaacttcaaattgctttacatatgcaaatgattattttattattgaatctgaaagattatgccaaattatgcttcatctaattttttgagaatctcatcctttggtcttgtcattcatcttcttacatgatagatggatctctgcccagcactgttctaaaccttttacctatattacatcttgtaatttcctttaatcctcacaacaaccttctaagaagtagacattgtaatttctgttttattattgaaattccaaaaggttaagtaaccattttgaggtcacagagtagtaagccatcagtgttttaagtttttcatatttcattggtatcacttccctttgttctgtttcttccttgactattgctttatatgggtgacatcctgatactgtagcaaagacatggtgtgacaactggccttcatatccctaatagtcttaatatatgagcagactccattctgtgtattaatgtcagatattaacacagggaaattgggctattatgacaaaaataggagatttaaccattttcatatatttatatgaataaatcttatctctttataaaactcacatttttaagggtagctaaaatttttatcatgatttttaaaattatgttataaacctatatgttaagaaatatgataaatatatttcttacagatatatcattgttcaaactttagagatggcattagggtaatttaaggaagaaatttgaataatactttgtgttcataatacctatacaatgtatttagctagtcaacagttgtgttcatctttcatactttatgtagcatctaatacagtaccatgctcatgagccttgataatttggccattaattaagagtggaaattagaactatgaaaatcctcatggaatcttttttgctttttctggtaagaatctcagaactaaatttagtctttattggtaagataaatttctacctgaataatggtgtacctcccctccctttttcctaaatcatgggcaatcttaatttcctcgttgcctccctgccactctttactgacctttctaatgtctctttatagtatgccacatcaaatcatttttttaaaagaagaagaatataaactgtaaatgagttattaaactgtaaagggagtttggttgtgatgaaattaatgaccatggtttttgcctattggagcaaaccacaaataagatacatgtgtatcttgcagaaaatggcgtggccctagtggcaaataaatcagccaggtaggggacatttcagaactaaaatgctttaattttcttaacaaagattttctcagcatcaagggctggcagtgattctacctcagcaaagtcaaactagagaaggtaaaaggagccccttccccaaatacttttcggatatatatatttaaaaggaacttgtttttgcctgttgaaagagaggtaaaagtcacagaaagaccaagaactgtcttcaaaaagaatgtattaatccagttccaacagagtgagaatacaccttgagattcttaatatatcaactaacattgctctttgagtcttttgaaatgtctgccaaatagttgatggagaaacctatgtatttttttaaacgtaaatctatgtaaacttgagtactggcagataattaataaattaattaatttagtgcagataagcattccctagaaacatgcttaccacctttaagagtacagtgagcccttaatctctcctgtctctgattgtggtttcttatattgctggtgagaattttcagtaaatgaatactgtttaaattttttgtgtctcataatcttatttttcttttagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtaatgtaactactaaatgatttacaatctccccttctttagaaaccctgatcccctccccttctctagaaacccggatcccaccccccttcactgcctctttgctctgtttttaagcatgcatggaattgttgttgtttttcccatagtgatcttccatttcaacctcctatttaatataagaatcccttccaagacatcaccaactcataaattcattctctgcttgaatgctttcagagactagaagctctaccttgccaggcagcctggcctattgtcaaatacttgtttgttagaaaatttttccttgtgctgaataggaatctgatttttagtctcacccattgatcataactgccctaatgccagacaaggaagcattagaccatctcaatacagtcattttacccagaaataaatggatttgacaataggaagcaagtctttggaactttcaaatatatccaactgcttctgagttaaaatcttatccccctaatgtcaggactactctgacttgattctgtgcctccagcctcctcccagaacagttaatacttagcataaccatcagattatatttgattatgccatttcccaatttagcaatattcaagaattcccaccttctatagcagtgctttgttttgtttgggctttatttttattatgcataaatattgaagagtcaggtcacacttcaggctttagcagtagtttaggctgtgcttcaagaggcagaggggtttagaaggctaagggctgcatggaggcaagtaggagaccaagtgagaatacctaagagcccatgcacacttccactgagaagggttcccctgctttcaggagtaatgttaaaaagttggaaaactaccattcttcaggataaacctcaaacttctcttcctggcattccatggcttccacagcctggccccagagtttctttccaaacttgcctaaaattttcctgtataagcgtgaccctcttgccctctcataggcacacctctgcatttgggctctcagagttctccctccagagtgggcttcccctcctgccaacctcctcagcatccactttgttgaagacctagcttccattgtgtattattggagaagtccctgaaccctcacttgtcatgccctgccctacctctgacctcacagagcatttgtcattgctgttaaatgatatgtaactagagtgattttaaaggaaatgaaaaggaattctttgttctcttccttcattcccccttcttaaaaattgcttgttgataccctagatgcttctaatgaaaaacaaactcattccagaaataagagcttatctgtttccattccattttacttatgagggaactgcagttctacaagtacttacctgaagtcacagagctagttcatgccgggagacaagttgtctaacttctagcacagtgctgtttctacatatgtcatctccctggacatgtggtaacagtaactaacttccagttaatagccacccaaatatattacaagttctttaaggcattcagggttttcttacccaattcttttagaggtggctattgcgttagatgacagaaccctgatgataaaatttctgaatgggctggaactatggctgtaaatccaaaagataaaatttaacaaggctgaatgaaatctgcatttggaggtaatatggtaactacataaatgccaacagggttgttgttgttgttttttgttgttgttgttttgttttgttttgttttttgagacagagtttcactcttgttgcccaggctggagtgcaatggcgctatctcggcacaccacaatctccacctcccagattcaagcgattctcctgcctcagcctcccaagtagctgggattacaggcatgcaccaccatgcccggctaatttttgtatttttagtagagatggggtttctccatgttggtcaggctggtctcaaactcccgacctcaggttatccgcccacctcggcctcccaaagtgctgagattacgccaacagggtatttctaacacgagagcaatttgtgtgaaagagacagaaggtttcatggattgcctcaggtaagcagacaaagagaaactttccagattagggcatagtagttccctggtacagtgctgaggtcatcatgtctggagagcccttcttcctctgaatattcccaactgctgactgaggagcccattctcctgtgtctttgtactgctctgcctccacatcctttatggtctggcctcccattcctgtggcatggtagccctgccttgctctgtggctcggggccttgctagcactccacagattcagtgagaggagagcagaaagcctaaagactccacagtgctcaagggaggtgtcaaaaagaatatagtcaaggcaggatagaggtctctggaaggtggggagccggaggaacgactttgccatttatgtgcagtgagaatcagtctgtatgtggcatcagaaaaaaacagcagtgttgaaactgacagataacatggagaagtttaaaaagatagaaaactaatttgtttagccatagggacagtcatttacgtaacaatttgctacttatacctaataatcgtggtgcaatagccattatacatatatatgtctgattaacttgtctgaattatacttcattatagccctaaattctattcatgggcaccaagcctttttgttcattgctcttagatcttaattgtcagttcaggtagcaaagtaaactgcacatacctttaaaaagttaaaaccaacactgcatttttataaaatgaggatgcgtggccaggcacagtaactcatgcctataatcccaggactttgggaggtcgaggcaggagaatcgcttgagcctgggagtccaagaccagcctgggcaacatagtgagaccccatctctacagataataattttttaaaaattgcctgggtgtagtgacatgtgcctgtggtcctagctactcaggaggctgaggcaggaagatcacctgagctcaggaggttgaggctacagtgagccatgatcataccaccacactccagcctgggtgacagagtgagaacctgtctcaataaaaagttggggcgggggggatgtgtatataattacctgggaagttgagggggatgtgtatataattacctgaaaagatatcttgagtgtgtcagtttgttttttttgcctctttattcttaaaattgtttatttaaaagttgatttaatcatgtcttccagttagctaattctctttttttctaattttatttccatggtttgttgggaaacaggtgatgtttggttacacgagtaagttctttagtggtgatttgtgagattttggtgcatccgtcacccaggcagtatacactgcaccctatttgtagtgttttatccctcaccccttcccaccctttaccccttagtccccaaagtccattgtgtcattcttatgcctttgcatcctcatagcttagctcccacttatgagtgagaacatatgatgtttggttttccattcctgagttacttcacatggaatagtctccaatctcatcctggtcactgcgaatgccattaattcattcctttttatggctgagtagtattccatcacatatatatatatatatatatgtatgtatgtatgtatgtatgtatgtatgtatgtatgtatgtatacacacacacacacacacacatgccccagtttatccatttgttgattgatgggcattgggttggtttcacatttttgcaattgcgaattgtgctgctataaacatgcatgtacaagtatctttttttacagtgacttcttttcctctgagtagatacccagtagtgggattgctggataaaatggtagttctacttttagttctttaaagaatctccacactgttttccatagtggttatactagtttacattcccaccagcagtgtagaaatgttccctgttcactgcagccatgccaacatctactgttttattttgttttgttttttcaggggtaaggtggtatcacattgtggttttgcaggggttaaggttcttcttggaggggtaaggtggtatcgcattgtggttttgatttgcatttccctgatcattagtgacattgaacattttttatatgtttattggccatttgtatatcttcttttgagaattgcctattcatgtcattagcccactttttgatgggattatttttttcttgttgatatgagttcattgtagattctggatattagtcctttgtcagatgtatagatcttgaagactttttcccactctgtgggttgtctgtttacttgctgactgttcctttcaccatgcaaaacctctttattttaattaagtcctagcaatttatctttgtttttgttacatttgcttttgggttcttggtcatgaaatctttgcctaagccaatgtctagaagggttttcccattgttatcttctagaatttttatagtttcaggtcttagatttaagtccttagtccatcttgagttgatttttgtaaaaggtgacagacgaggatcagtttcattctcctacatgtgactagccaattatcccagcaccatttgtttgaaaagagtatgctttccctgctttatgtttttgtttaccttgtcaaagatcagttggctgtaagtattgggctttatctctgtgttctctattctgttccactggtctatgtgcctatttttataacagtaccatgctgttttggtgactatggccttatagtatagtttgaaatcaggtaatgtgacacctctagatttattctttttgcttagtcttgcgttggccatgcgggctcttttttggttctatatgaattttagaattgttttttctaattctgtgaaaaatgttgatggtatttttataggaattgtggtgggaattgcattgagtctgtagattgcttttggcagaatggtcattttcacaatattgattctacccatccatgagcatgggatgtgtttccatttgtttgtgtcatctgtgatttctttcagcagtggtttgtggttttacttgtagaggtctttcacctccttggttaggtatattgctaagtatgttttttgtttgtttgtttgttttttgcagctgttgtaaaaggggtcgagttcttgatttgatactcagcttgctcgttgttggtgtatagaagagctactgattcgtgtacattaattttgtcttcgaaaactttgctgaattattttatcagttccaggagttttctggaggagtttttaggatcttctgggtaaacgatcatatcatcagcaaacagcgagaatttgactttctctttttttttttaattaattaatttatttatttattttttttttttcctgagacggagtctcgctctgtcgcccaggctggagtgcagtggctcaatctcagctcactgcagactgcaagctctgcctcccgggttgacaccattctcctgcctcagcctcccaagtagctgggactacaggcacccaccaccatgcccagctaattttttgtgtttttagtagagacggggtttcaccatgttagccaggatggtctcgatctcctgacctcgtgatctgcccgcctcggccttccaaagtgctgggattataggcgtgagccaccacacccggccgacttcctctttattgatttgggtgccctttatttctttctcttgtttgattgctctgactaggacttccagtactatgttgaagaagagtagtaagagtgggcatccttgtcttgttccagttctcagagggaatgctttccacttttcccaattcagtattatgttggctgtgggcttgtcatagatggcttttattacattgaggtatgtcccttgtatgccaattttgctgagagttttcatcataaagggatgctggattttatcaaatgctttttctccatttattgagatgatcatgtgattttggtttttaattctgtttttgtggtgtatcacatctattgacttgcatatgttaaaccatccctgcatccctgatatgaaacccacttaatcatggtggattatctgtttgatatgttgttagattcagttagctagtattttgttaaggattttagcatctgtgttcatcagggatattggtctgtaggtttttgtttgtttggttggttatgtcctcctttcctggttttggtattagggtgatgccggcttcatagaatgaattagggagggttccctgtttctctgtcttgtggaatagtgtcaataggattggtaccaattcttctttgaatgtctggtagaattcggctgtgaatccgtctgtccttgactttttttgttggtaatttttaaactaccatttcaatatcactgcttgttgctggtctgttcagggtatctaattcttcctgatttaagctagaagggttgtatctttccaggaatttattcatctcttctaggttttctagtttatgtgtgtaaaggtgttcatagtaaccttgaatgatcttctgtatttctgtggtgtcagttgtaatatctcctgttttgtttcttattgagcttatttggattttctctcttcttttcttagttagtcttgctaatggtctatcaattttatttatcttttcaaagaactagctttttgtttcatttattttttgtattttttttcttttgtattatttttttcaatttcatttagttctgctctgatcctggtcatttcctttctcctgctgggtttgggtttggtttgttccattcttgtttctctaattccttgaggtgtgaccttagattgtctgtttgtgctctttcagactttttttctttttctttttctttttttttttttttgagacagaatctctctctgttgccaggccggagtgcagtggcgtgatcttggctcactgcagccagcacctcctgggttcaagtgattctcctgcctcagcctcctgagtaggtgtgactacaggtgcgcactactacacccagctaatttttgtattttttagtagagacagggtttcaccatgtttgccaggatggtctcgacctcttgacctcatgaaccaccgacctcggcctcccaaagtgctgggatgatgggcgtgagccactgcgcccagcccagactttttgatgtaggcgtttagggctatgaacttttctcttagcattgcctttgctgtgtcccagagggtttgataggttgtgtcactattgtcattcagtttgaagaatgttttaatttccatcttgatttcatttttgacccagtgatcattcaggagcaggttatttaatttccatgtatttgcatggttttgagggttccttttggagttgatttcaggttttattccactgtagtctgagagagtgcttgatataatttcaactttcttaaatgtattgaggctcgttttgtggcctcttctatggtctatcttggagaaagttccatgtgctgttgaatagaatgcatattctgcagttgttagatggaatgttctgtatatgtctattaagtccatttgttccagggtatagtttaaatccattgtttgtttattgactttctgtcttgacctgtttagtgctgtcagtggagtactgaagtcccccactcttgttgtgttaaactgtctgtctcatttcttaggtctattagtaattgttttataaatttgggagctccagtgttagtgcatatatgtttaggattgtggtattttcctgttggaaaaggccttttatcattatgtaatgtccctctttttcttttttaactgttgttcctttaaagtttgtctgatataagaatagccactcctcacttttggtgtccatttgcctgaaatgtctttttccactcctttaccttaagtttgtgcaagtccttatgtgttaggtgagtctcttgaaggcagcagataattggttggtgaattcttatcaattcttcaattctgtatctttaagtggagtatttaggccatttacattcaacattagtagtgagatatgaggtaccattccattcatcatgctatttgtttcctgtatatcttggttttttgtttttgttttttaaattgcatttttgttttataggtcctgtgggatttatgctttaaagaggttctgttttgggtgtttccaggatttgtttcaagatttagagctccttttatcagttcttgtagtggtggcttggtagtggcgaattctctcagcatttgtttttcggaaaaagactatcttttctttacatatgaagcttagttttgctggatacaaaattttggctgataattgttttgtttgaggaggctgaagatagggccgcaattccttctagcttgtagggctctgctgagaaatctgctgttaatctgataggttttcctttttaggttacgtagtactttggtgtcaccactcttaagattctttcctttatcttaactttagattacctgatgagagtgtgcctaggcagtgatctttgtgtgatgaatttcccagatgttctttgtgcttcttgtatttggatgtctaggtctctagcaaggctggggaagttttcctcaattattctcccaagtatgttttccaaactttaaatttctcttcttcctcaggaacaccaatcaatcttaggtttggtcgtttaacataattcttgactccttagaggctttgttcatattttcttttttttttctttgtctttgttggattgggttaatttgaagaccttgtctttgagctctgaatttctttcttctgcttgttcagttccattgctgagactttccagagcattttgcgtttctataagtgtgtccattgtttcctgaagttttgattgttttttatttatgctatttccttgaatatttttcccttcacttgtatcattttttggatttccttacattgggctttgcctttctctggtgcctccctgattagcttaataactaaccttctgaattctttttcaggtaaatcagggatttcttcttggtttgggtccattgctgataagctagtgtgattttttgaaggtattaaagaacattgttttgtcatataaccagagttggttttctggttccttctcatatgggtaggctctgtcagaggaaaggtctagggctgaaggctgttagtcagattcttttgtcccacagggtgttcccttgatttagtactctcccccttttcctatggatgtggcttcttgagagccaagctgtagtgattgttatctctcttctggatctagccgcccagcaagtccaggctctggactgctactgggggttgtctgcacagcgtcctgtgatgtgaaccctctgtgggtctctcagctgtgtataccagcacagtatttggggtgcctcttgggtcccacaggaacagtccgcttccttcagggggtctgtgggtcttctcaggtttcctgatttattcctgcagttgttctggagcgaaaattctcactgcaagcctccacacactgctctgtctgtcccaagttggagctgcagtctagtcctgcctcccgtccaccatgatcccctcagtcctcagagactttttattactcctaattctcttttaatttagcttttacttggctattgcagtctattagtactcactaagtcatccttattttcgacagttctttactatgcatgcaagtcttttctggtaccaggcagtgagctctgtgtctccagcacttactgttcatattcttatgataggttggcataggaaagaggagaagagaggcaacctttaaggagtaaggaggagagagtttgttagagcaataaatgaatgttcttatggattcttgtagtttataaagttatttggaagaccagcttgagtttgccgcttactcttagtggcactcaagtgtagctgtaaagactgggatctgtttttaagtgcctagaaaactctgtgtttatggaatctgcatctgttggtgaagtttagctcattcatcttagacctcaaacagccctgaagaacttaatgcttacatctggttaaattctcagtgtgtagtttgtacgtttttccacagctttaagtaatgatagagaagaaaagaatagagaatgaatctcagagaaatgaaagcaacttaggaacagaaacagagaaacagtaagaaatgcatttttcagagactgggccaaaggattcatcatggagttttaacttctagcagaaagttgaggaaaaggaataagactcttttctgaaccatacaaagccccgcagctcctgtcttctggctgacatagcaccatctttacccatcacacctgtggcctggaaggtagcctctctgtacctgaatttcttcatctgtaaaatgggattaaaaaaatcactgccctcatctatgtgaggatcacgtgaaggccaaatgaaattacaagcctgagacatctttaaatgttgaaagaagattacaaacattgggtaatcatcctctcctatgtgtatcattagacaaccttgctttggattatttgttttgttggccattcttagatcaaatcgtaggtgttgatcaagttttctttgctccagaactttgattaccatatattgactcgcctccccctctaaaaataagtttcctaaatctattttctgtatctctgtgtatacccacttgctatccactcttcctttgtaaaaaaaaaaacaaaaacaaaatgtcagtattcacacttcacacttcaacaagaaaaagcttgttctctcttctattaataaaagtgctattttcttgccttcagattaataccatttactgtttaggttcttattgatctcctggctccttttaccttaaatctttgatttttaagcagatgcaggctagcatactttttttaatagagtgtaatgtccatagcccttaccattctgcctttcccattttttccctttgtcatttttccaagggcataataccctcctgctgtataacacttggctactcagggtaccccactatgagaacaataggctgaccttttccagtctacttcagaacatctttgttctgtaccctgtctctgaggattttgcctctgggtcataataagtttattaatcttcagagacttaatcctccttatgagctggtgtatatccattttaataggagtcttctggagaaaagactgtaagagaatgaaatttgcttagttagtggaagttaccccacagaaggtggtaagcacacagcccctggaagtgtttctgatcaggaagttaaaagattcctgatcccttccagttctgaaaaattcatgagtgactctaatggtgggagtttgaagcactttggtaagccagttccagcgtctccgcacaccgtctgtttgtggctccattcaccctgcctccatgatacagacgattctttcccagtagttgccactagcccatcactaagactgtctaagagcattttcttggcaaaccaccattctgcatgaaaggagagtctaggattggggaaagtggattcaacagcttatacagccagagtatattaattgtgagctttgcaccttggtaataattatgtatacaataaacaaaatcacatggttgctaagcaacacctttccctcattcttgaccccagtggaggtatgagatattcgacctctggacttaaaaaatcttaaattctgctctgcttgcagacatgctttagtggccctggcagtagcagcctcttatttctgccctgtccttacctcccttggcttgaatcttgccttccatatctccatgaacccagcagcctggatgttctttcaggataactaatgtcagactaggtactcttcaggctcctgtgggggtcccctgtgcactgaagtctcacaccaggagcagcttcacctaagcctaaggtggatgcacatctagtcttcctctagaggagaggcttttcctctgtagaatgatgagggcgcaacagatcctgggtctaatgtgaataataacatatttatctcataacaaaatgtgacttgttgaagagttccacatttgggatatgttttctgtgtgtgtagaaattgagatgatttggagactatttctttgctaatagtaacgattgtattattacttacagcagcggtccccaacctttttggcaccagggactagctttgtggaagacagtttttccatggatgggggtagagtgggggtagtttcaggatgaaactgttctgcctcagatcctcaggcatgcgttagatagagtgcacaacctagatcccttgcatgcacagttcacgatagggttcactctcctataacaatctgatgctgccactgatctgacaggaggtggagctcaggtggtactgctcgctcacctgcccttcacctcctgctgtgtggcccagtacctaacaggccacggactgttacctctccatgtgtccatggcctgggacttggggacctcttcctttcaattaaaaataaattgtccttttactctcatgagaaagagagttcttactaaatttacctcccttttcatagagaattttttctccttcaggttttttttaattgaaaggaagagctttttatcgagaaaaatcaataccttttagggtactaaaattgttttatattcatttccagtctttcctaaggctttgtaatcatttgtggtagcctctaatatataaataaattatagcattttacctttcatcttttacctgaattataaccatttaaatagatatgatagctgttttcttgagcagtctaggattttctggttcttcttgaacctgggacttaataacataataggcaaaggagagagaaggagataggtagtggaatattaacacgaagttattttctgcttaaggaatgaatgaaggacatatattacaactgtgacattcagtcatttctttttctttctagaaggtagtaaatttataagagtggtaagccaagtataatggctcacgcctgtaatcccagcactttgggaggctgaggcaggtgaatcatttgagatcggaaggtcaagaccagcctggccaacatggtgaaattccatctctactaaaaatacaaaaatttgccaggtgtggtggtgggcacttgtaatcccagctactcaggaggctgagtcaggagaattgcttaaacctaggaggcagaggttgcagtgagctgagattgtgtcactgcactccagcctgggcaacagagcatgactccgtctcaaaaaagaagaaagtggtgggaagggatgctgtttgctttaactgtcaggttggaggagggaatcactttaaatggacttggagaaaacataaatgaatttccgttttcttcattgaacatgttctcttattttgtttcccctctgcctctctctgaatctaccctagttgatatattttcctatgctccagttttgttctcctgagggctcttccatccactgtggcatgaagggtaaaagccacaaagatcttttctttggccgtgtcatctcttcattccctgttggcttaccctgtatgtgttttctatttgcaggtctgtggctgtcctctctattggaaagcccccatgttcagggctgcagggggagagaagacaggatttgtgacagcacagtcattcattgccatgtggagaaagtaagtatgtgagcagtctctctggagctaggcaaagaattgtgtgaccctcatgacatgctttctaaaggtcacctattttactcatttatacattttccctttactctttatatcaacaaggaaaattcaatgatttacaaccatttatactcacatacaagttctttgccacaagcctttatctaacctctttaaaaaacagtaaagcagatctgcagaaatctttctttaaaaactatttgatagtttattagttttacttggtttttcttgtttttttttttgtttttttttttgtttttttttttttgagacagaatgtcacttttttgcccaggctagtgtgcagagacctaatcatagctcactgcagccccaaactcttgggctcaagtgataatcctacctcagcctcctaagtagctgggactacaggcaggcaccaccacacctggctaatttttatagagactggatctcactctgttgcccaggctggtcataaactcctggccttaagcaatcctcccagctcggctgcccaaagtgctgagattataggtgtgaaccccacacccagccacttttacttgttaaatttgggtctcaggatttgaatctggcagcagtgaaataagcaaaaaggaactcccctttatggggggcaaatcagatgtgtcacatgggaaatacattttcattcccatagatccaatttagaattatatatagttgatttgttagaaatactgaattctaatagattttaatcattaccttttgaaagctccagttaaggaactgaaggactagtatatttatcaagcttttcctggattctaacattctgacaaattttcttgaattcaaacccaacatctttcttctttatctcttttttctcccttctttcttctttaggagttattttttggtatatttatacatcttagctaagtatcacagcttgccccttctgcctcttttaactgatcagcacccttgttatgcatgttcttctcgccttttctgagctaaatatccttcctggtaaactattgggaaatgctactcacctattgttattattatttaacatcaacctataatagcagcagattgaacagacagattctttctaatttcttcatttcagctaaaagcccttaataggataatgcttgagaatatagtaggtgattaataaatgtattcttatttttaaaaatctagcagcaggtcaagttcaagttcttcatacatcacattagaactaaagagtctatgttggtggagggtattctcataagtgagaactgaacaatgagaacacatggacacagggaggggaacagcacacactggggcctgttggggtggggtgagggaagggagagcattaggaaaaatagctaatgcatattgggcttaatacctaggtgatgggttgataggtgcagcacaccgccacagcacgtgtttatctatgtaacagacgtgcacatcctgcgcatgtaccttggaacttaaaaataaaaaaatttttttaaaaagagtgtatgttggtggatagatcatagccaccaccacaatagctgtattttattcagatgaattgtttaaattttatctgtaaggaagacatttctgcaaaacgcaaaaagcgggggaaagacatgaagtacaagtctccattttggttaactgcaggaaaattgcttatgaagttatatagcatgagcaactatccctgtctttttttcatcagaaaaattctatgaatagataagtgtgtctctaaattaaagtgttattttacagtcagatattaaaatggtttgagtgccctctagtggaaactcctctttgagctcttaaaatgtcttttaaaagccagggtgcttgaagggagccccaagtgtggctattttgggagactaagcagctaaacatggtggtgtgagttaccacgttgaccttggagaagacgtgtttagttttgtaattttttttttttgtaacatttgcataaagcaatgtgggctcaagtatagtatattaaaactttcaaataaaaaaattgctaacaggtaattatacagaattaaaacattttggaaaatacatatatatgctgatttgctccagtagctctacataatcttaaaaaaaaaaagagtcaaatataaaagtcataagaatatagggaaatggccgggcgtggtggctcacgcctgtaatcccagcactctgggaggccaaggtgggcagatcccgaggtcaggagatcgagaccatcctggctaacacagtgaaaccccatctctactaaaaatgcaaaaaattagccaggcaagatggcgggcacctgtagtcccagctactcaggaggctgaggcaggagaatcgcgggaacccaggaggcggagcttgcagtgagccgagatcgcgcctctgcactccagcctgggtgacagaacgagactccatctcaaaaaaaaacagaatatagggaaataatttctctcatgtcagactgctcatggggtggaggcctcagtatctctcctccaaagggctctgttccacttcctttccctgtgccgctgcccatttcatgtctatactctgacatatattcttcttatagtcaggacatttttaggagaaagacattgctccatagcatttctttttgaggtcctagagtatcagcttttgggcagaactcatctcaaatggaatcaataatattgcttcagctttattatgctttactttcttttaccttttcatatcaatgtatcatttgtccattaacaaaataacattttgtcctaaaagttctgaaagatgctagtttagaatagctatgcttaccttcattctttagctttcatgacttttatcatcttttctcctgccatagagttgaccagccagtaacactggcagaaaattgtaattcaccttttctttctatttcacagcaaaagaccatttctgatttcactttgtcctctcagagtagctctcatctgtcatgtctctgctgtttttatatcttactattctgttttatatatataagtagttcttttgaaagacctcactgtttttctattgtgatcatcccacccattttctaatcctgagaggtggctcctattagcatctattgcgtgaatctttttctgaaacatgtgtttatttaactttaggagccttaagcatgttgaggaatgttatggagaataagtataaaaatcatagtatagctctaataagcacaaatgaagtatacatctgtttgatcaaaaacattttcttatttttcttccttaatcacttgttgaatgctaactatatgccaggtattgtgtctggtcttgagggcggttgggatacaaagaaagtaagacagttttataccctgtaaggagcttacagtctagtgaaagagttacaccaagccatgtgtgctggcttgcacctgtaatcctagctacttgggaggatcgcttgagcctaggagtttgaggctgcagtaagctatgatcatgagactgcaccacagccttgacaacagaatgagaccctgtctcaaaaaaaaaaaaaaaaaaaaaaaagacaaggatgttaagatggccaagaagacacagccagggagagcttctctttcctaccaagagaaaccaaaatattgagtaaaccagcatactttgaacagaccttttaagagaaagcactgagagtcagtggagagatgatgcagtcactgaggctgaagagggaggaaactgagaaccctgcatgggctctgaatggctcctaaggaaggggtgaaagaagtaactgcagagcaggccactgtcactgtggacatctgggattctagctgcaagagatcccacagccaccatggacgtttgagttggcagggaaaactgcttggagagctggcagagacagagctcgaggctacacagagcccatggggttttgcatgggaacagctgcaacaaaacacaaccataggcacctatcccccaaggctctccatattcctctaagaggctctaacctttgttgactgccagacctggagagagcagggctgtctttcccacaggaccagggcgtatctgatccatgcactcccctgtccaccagcccctcccagggctcctgtctggcttctcccataggagcaggcacacagcacagcctccactcccctgcgagagcgcttttgccagtggcccccagtggagcgcttttactggtggcctgggagcaccttggctcacccagcacagctggtgctcgacctcagggagccagagaactaagctacaggcctggtcccaggcccccagggttagagcacacagtccaggagtgccaagctgagacttgtggttggaactcaagtggcggaagagcccttactctcagagcactgggaaaagtgaggtatggattaatgggctggcacaggaactgggccacaacctctacccaagggagcctggcagtctggaacacctaatagcccagtgatctgggtgcagaagtcttgtgacaaactagctggttgggccaaattctgggcagtaaccaggagacctgtcaaggaagcacaagctgggaagttctcactgctatctgctggccaaaaaaacctaggctgtgggcaccacaccagctgcacggccaaggcagcatcaccctacccagggatccctcacccttgacctactgcatgaacagaccacccacagacatacccctaacctgcagtctacctggtagcccttactattaaatgccatctcccaggttacagcttgaattacagcaccaaaaaattccagcatgaattgcctgagaaaacccagtacaggattctggccacaaataaagatcccatacaggccaggcacagtgactcatacctgtaatcccagcactttgggaggccgaggcagtaagattgcatgagcctaggagttcaagaccagcctaggtaacatggcaagactctgtctctacaaaaaaattagccaggcatgatggtatgaacctgtggttccagctgcttgggaggctgaggcaggaggatcacttgagcccagaaggttgaggctgcagtgagctgtgttcacgccattgtactccagccttggtgacagagccaggctttgtctcaagaaagacagaaaactgtaatcccagcacgttgggaggccgaggcaggtggatcacctgagggtcaggagtttgagaccagcctggccaacatggtgaaaccccatctctactaaaaatacaaaaaattagccgggcatagtgatgggcacctataatcccagctactccggaggctgaagcgggagaatcatttgaacctgggaggcagaggttgcagtgagccgaggttgcgctgttgcactccagcctaggcaacaagagtgaaactccatctcaaaaaaaaaaaaaagaaatccagaagagattccatacagagccttggccctctgaaagcatgcagaaataaagccaattggctatactcagcttgcaccacagtcaaaccctcaagggaaataaagtaaaaacaaaaaagctccatccaaaggacaaaggacagcaacatcaaaagataaaggaacacctgccctcacagatgagaaggaaccagcacaagaactctgacaattctaaaacccagagtgtgttcttacctccaaatgatctcactagctccccagcaatggttgttaatcaaattaaagcagctgaaatgacagaattcagaatctggatggtaagaaagctcaatgaaatacaggagaaagttgaaactcaatccagggaaaacagtaaaatgatccaagagttgaaagatgacacagccattttaagaaagaaccaaactgaacttctagaattgaaaaatttactacgggaattccataatacaactagaagcattaataacaacagatcaatctgaggaaagagtctcagagctcaaagaccactcctttgaatcaatgcaggcagacaaaaataaaaaagaattttaaaaaatgaaaactctcagaaatatgggattatgtaaagagaccaaacctataactcattggcattcctgagagagaaggagcgagagtacgcaacttggaaaacgtatgaggatatagtccacggaaatttccccagtctcactaaagaggtggacatggctgaactccatggagcagtttggagatttctcaaagaacagagtttacatttcaatccagtagttctattactgggtatatacccaaagaaaaataagtcattctgccaaaaagacttatgcacccatatgttcaatgaagcactgttcacaattgcaaagacatggaatcaacatacatgcccatcaatggtggactggataaagaaaatgtggtacaggtacaccatggactactaagcagccgtaaaaaagaatgaagtcttgttctttgtagcaacatggatgcagctggagaccattatcctaagcaaattcgcagaaacagaaaaccaaataccatatgttctcacttgtaagtgggagctaaacatcaagtacacatggacataaagatgagaacaggccgggcgtggtggctcacgcctgtaatcccagcactttcggaggccgaggtgagtggatcacgaggtcaggagatcgataccatcctggctaacacagtgaaaccccgtctctactaaaaatacaaaaaaaaatttaggcaggtgtggtggcgggtgcctgtagtcccagctacttgggaggctgaggcaggagaatggcgtgaacccagaaggcagagcttgcagtgagctgagattgcgccactgcactccagcgtaggcaacagagcgagactccgtctcaaaaaaaaaaaaaagatgagaacagtagacactggggaatacaagaaagggtagggatggagggagcaagggctgaaaaactagctattggtactatgctcactacctgagagatggattcgttcatactccagacctctacatcactgagtatacctttgtaacaaacccgtacatgtacccctgtacctataataaaagttgaaaaaaaaaagttattccaataaggttatgctattgtggaacagccatgacagaaataataagcacatggaaggacacaggaggccagcaagagttcctggaaggtgaagtaagggaaaagggtattgtggtaaggacggtagcatttacaaatgcctggtgtgagaaggcatggaacatttgtgcaaccacaagtgcaggaatggtaagagaaggggacatgagcaggtaggatcagattctggaggcccttctatgtcaggtcaagaagctaggactttaggccaggcgccgtggctcacgcctgtaatcccagcactttgggaagccgaggcaggcggatcacaaggtcaggagatcaagaacatcctggccaacatggtgaaacccccgtctctactaaaaatacaaaaactagccaggcgtggtggcatgcgcctatagtcccagctactctggaggctgaggcaggagaattggttgaacccaggaggtggaggctgcagtgagctgagattgtgccactgcactccagcctgggtgaaaagagcaaaactccgtctcaaaaaaaaaaaaaaagctgggactttagcctacttgacagaagaattttaatttggacaatgacgtgatcaaatatgttactcagaaatatcaagcaacaaacaagagcctaagcatggatattggcagtgggagacagaaagaggcaaatttggtagaaatgaaacaacatggtagttgataggtgtcggggtaaaaggaagggagaagttcatgacgactcccaagtttctagcttgaaccattgggtgcttggaatactagatgaggttactggagtcctgaggaatgtttcctgaaaatgctttagacagctgttccttcctgtttccgttttaccatcaaggtcaaggccttattacttcatgctgagacccctggaagggaagagggtctaatagacttcagtactcatccaaccttatagacagctcatcattctaaaacatcctttgattatgtaaattccttacttgattgttgatctgagtggccttcagatcaaactgaaattactaactattgatgttattgtcattgtttgttcagaggaactaatcttcctaagcagttgtttcttttataggttgctgaataaccatcatgatgatgcctctaaattcatctgtcttctagcaaagcccaactgcagctctctagaacaggaggatttcatccctctacttcaggtaattttcatctccttttgaaaatgggttctaattttggagtttcagcagttttgtttaaaatttacaactataacatgtcaattgagctacacagatctagatatcagattctagaagagtggttttcaaacttgttttagcagtaagatcctctcgttaaatgaaatctcgttaaatgaaatctcgttaaatgaaatctaaaacagaacccatagtagtaaaagagctactccttcagggctactcccactgaagcagaggagaggggccactcatcctcccccttgcccacccacagcaatcactgaagcaccttctgaaatgatagaatgcaagaagataacttctctgttagcgtagaacatagctaagaacctggtagaaagaaagaaaaggtcatgatgtaaccaggatcactctcacgaactctggggtcttcactcactgcctcctgacccattatttaagtacagtttttaaatgcttggtttcctgattcttcaacccaagatatatttgaaacagaaaattagaataggagaagggaaagaggataactagaatcaagtgcatggagagctgcaaaaaacagactacaccaccagactacaaaggtagtgaggagagtaagaaacactaagagaaaaaaaagacccagaagctctaaatgtactctagtgtgggagtaatttaggataatggcagtagtcccaatcccattaccagatttcagctgagattagtaatttattttagtagcatagactctatatgtacttatctagaaaactcatttatagggagcagctttcactgatggaaccagataaaacaatggcactgtacttctcatttttccttttctgtgtatgaaattttaaactctgtgtgttgtatatccatatattatacatgtaaaaaaaggataagtctcagacctgaataaacgtcagatctatcagaagtataagtttctggatttgaatttctaactttagccttcgtttaccaggttggcggatatttttaacctcagaccttcctgaggtttctcagcctggagctgtgccacagttctgaggtcttacacggtaccaaagcattagggttgggagttactgctgagacatcagccatctttggctagcagattcccttcagatccagaggtctttgctgcttctgtgccacgtgtcaagccccagaacctttggtgaagatacccatggcccgtctgcctagatgcacacacagctgttttcttttaaggttttagctgcacccctagggtgttgccaggcagcagggtccctttgctcctatcacccacagacttctctttctttttcctgacactaagaggtcttctactctgcagaaatctcctgctgccatgttcccttatgctttcctatctctgccttcaattctccttgcttgtattgtctgcttccctttcaagtaggggtgagctccctactcactacttcagggcagagaagagaagtgacctcaaaatcttcatggcttttatggcactgtgcgtattgtaggcttaaatgcagggtccacagtcatttggcctagttgacctttgttaaggttttagagagagagagatgtctaacagaaagagcccacctggggagtgtttctatctaggccttcccatgggaatcagttacatatcagtattgcacctgtttctactatagcattcttcatagcctgagatattgcttgttaatattcttgttttcgtatctaaatatttggtttttctaagcagatcacaaattctttgaagctaagataagcttttcctgcctgttgaatgtgcatcattattttaggtgttacagtaaatccttgttagctcttagtatggatacctaaagaagggcataaaatacatggaaatagttgaggtttttttaagttgtattcatggctgccatgttttgttgttgtttgtttttttggagacggagtctcgctcttgtcgcccaggctggagtgcaatggtgcgatcttggctcactgcagcctccgcctcctgggttcaattgattgtcctgcctcagcctcccaagtagcagggattacaggcacccaccaccacacccgggtaatttttgtgtttttagtagagactgggtttcaccatgttggccaggttggtctcgaactcctgacctccggtgatccacctgcctcagcctcccaaagtgctgggattacaggcatgagccaccacacctggccatgccatgattttttaaaaagatttttgctgaaatataatcacacaaaacacccaaatcacaggtgtcctagtcaatgaattttcacaatgtgggcatatccgtataactagcacacagatccaaaaacagtattaccagcacctgcaaagcctgtcatgctccatcccagtcactgccacccaacaataaccactaccctgactaataacaccatagtacatagacttttaattatagtaacaatcttccatgtttaaaatgtgaagtttggttctgattttattttatgctcagggcccttgggcttgtctaatttgcataatggctttgattatccttagactcacctgctacatggttttgttcccctaaaaaaaatactcatgagaatgaagattcttaatagtttttggcatttaattaagaccattttacctgataatatccaacattaaatattcctatgttttgtgaaatctcaaatcttcaatatttgaactgcattgtaataaaacattaggttttattaccagttctctactgctctccatcctcactctctcaatccattcttggccttgctctgaccctacaaagtgcgtctttggggctctcttgctgactagcttttggttggatctgggcagtgggaagcattgccagtaaatgggaggacagaggaaagaaaagctggcatttcttccctgctctctgcctcggcacagtaactatgtctctctacaatacagcttctgctggacagccccttgtctgtggtcctagtgcctactaggctctcctcctccccttgttcctttggccctcaggactataacagtatcctcctgtcagtagtctctgggtgcctcattattcccttgtttgctcccttcatcctgctcacaactccacatgtaatcttttcgtgaaagcttcatacagtgaattctttttcctgtggggaccctatgctgactgatgcagttctgaattttatcagagctttaataaaagctttgacaggaatgtaaattaagtttagactaagaaaattagaaacagacaacaacaaaatcataattatgagttaacagacatttatacttcccttaaatctaaggagaaatcttatttgtatttaagaagtggacttgtggagtcttctggtaaaagagacaaactaaatagagacattatcctcccattctttcccaagcccttctgaagttaaagtgtagaaattaaaaaggaataaatccacggaagccaatgaaatggtagagaaaatcaacgtacaagaaatcttaacatatttctttaagatagaaagtgaccacatgtcttgtgggactgtggatggagctggaggccattatccttagcaaactaatgcaggaacagaaaaccaaataccacatgttctcacttataagtgggagctaaatggtgagaacttatgaaaacaaacaaggagacaacagacactgcggtctacttgagggtggaaggtggaaagagggagaggagcagaaaagataactattgggtactgggcttaatacctgtacctgtagtgaaataatctgtaccacaaagccctgtgacatgagtttacccatgtaacaaaccttcacatttactcccaaacctaaaataaaagtttaaaaaagattctgtgatcttaaaattgtaaataaatagtttaataataaatggatttatatggatcaaaaaaaaagaaaaaaaaataagtgaccagaagtaggctaagaaaaccacaacccagaatcaggagctgtgtgtgggctcaagtggtgaagtgagctcctgtgctcatcaaggcccagagcagttgtaaattcaggactgactgacccaatgagagatactggaaatggggattcactgaaggtcggtatacacaacaatcactagttgactcctttcctggttcacaaatataaagtgcagcctgacatttattcacaagcataaacacactaacaagacaataaagcatgctaaggcttctaatgtgacagccacagattaaaattctccttatttctctttattctggcagttggagatcccgggaggtctcaccagtttactctaaaataatgcctgtcaatcaacacacccaccctaaatgcacagaaccccgaggcagatttggtactcaagaaagatacctgttgaaaaatagacctacttatatttccacagaggaaaattatatcaaattatatcaactaccttgtccttcttaaacatgaatggacaaccaggtatatgaggaaaatgatcatcattaaagaaaaataaaggttaaaaaaacacatacacagaaaaagtagcccagaaaagaaacaaaactaattcaggaaacagaagaaatgagaatttttttgggggggaaataaacgtggtgttttattttctggattataaagtgaacaaatacttaaatactattatttctttacccagtgctttttatttctaagcacttttattttaaaaatgtgaattatataattccccctacacacatacacatacacctataagcacattaaatactactttgccatgacagctcggtatacttcacaattcttttttttttttttttttttttttgagttggaggctcgccctgtcgccaggctggagtgcagtggcacgatcttggctcactgcaacctccgcctcccgggttcaagcaattctccttcctcagcctcccaggtagctgggattacaggcacgcgccaccacacccagctaatttttgtattattagtagagatggggtttcatcatgttggccaggatggtctggatctcttgacctcgtgatccgcccacctcggcctcccaaagtgctgagattacaggcatgagccaccgcgtccagcctacttcacaattcttaacgctattctatgtggaatacaaaatgcctttttatctgaattaacatgcatttaaaaatatttagtatatgtgaaaataaaggaattataaatcagtaggaaagatgttcaggtaaaggcatcatcagtcagctcagtagatgttgtctacatttattttctacctttgtaaaacaagaacctgctaacagtcttaggtaaatggtaaagtaacatatttttgccctgatgccattggtcagaatgccatgagatagctgctgtgtgtttagtctcaatttcctgtttgcaaagaaatgcattaattcagttttctactcactatataattcggttgtagggatatagatatctcatttgagttctctgagttttttatctttatatctaaaaatttaatctgaaaatagtaaaagcagaaaacactgatttaaaaccttaaaatgctactgctcagtgcatgtaataaaagttaatgtttataaacatttcaatattttaaagtatatttccttaacttcaagaattttgactttgcttgctacaaggcttttttcctcaaagattccttttaggcttactttggtgttcaggatctccagttataaatatagaagagatgactgtgcaagataaaattaaaaagccagacatactttctatcaagctgcgtaaaaagaaacatgaagtacaaatggatcacagacctgagtctgttgtgttggtgaaaggaatcaacatctttacattgctcaattttttgatcaactctaagagtttagttgctacctcaggtccacaggtaggacttcctctgaccctcttatcccctgttgctctccgaggtgccataatgcaaatgcttaaggcacaaagtgtaaatgtgaagacacagctctttctggatacagagaccagtttagtttggagattacaggttctatcgtgcctcattctctgcattcactgaccatgctgctcaaatcttcacagagcgggtctttctctgcagtactgtatccacacgagccaactgctgtatttaacacctgcctgccaatggacaaagtacttgatacagaggttgttcataaggagcttactaactgtggtttgcaccctaagactctggagcaacttagagaaataccactacttgggaaatcatctttatggaatgtggtgatgagaattttttaaaaacaaattgcacatactgatataaataaatgattggggagaagaaacaaatctatgcagaattgcaaacagtttagtagacactgcagtcttaaagaggggagcgtaaatcaccattccttaagagtaggctatgcatagtgatttcagggtgtggggagtaactttacagtggaggagcctgacagatactacctcagtctgatgatcaaggccaacatcagcagtcatcaatcacgttgttagtatgtacctttggcaagatatggtgcaaaggacatgttacttctctggcctttctcccaaaaatccataaacccagtctaatcatgaggaaaacatcaggcagattccagtaatgaaatatcctacataatacctgagtagtactcatcagaactgtcaaggtcatcaaaagtaaggaaagtctaagaaactgtcacagccaaaagaagtctaaggagacataactaaatagaatatgatgacctggatagaacactggaatagaaagaagacatcaggtaaaaattaaggaaatgtgaataaagtatggactttaaaaataatgtgtcaatatcagtttaattttaacaagtggaccatatagtaagtgtaaggtgttaataattgaggaatctgggcgcagggtatatgggaactctcagtgctgttttcttaatttttttataaacctaaaactattctaaaaaaaaaaaaccagttattttaaaaagtactatattaaggaaggttatatacaataagaaccgtaaaacaaaacctttatcttacaccgtatataaaaatcaactgaaaatgggttaaagacttaaatgtaatacctgaaactgtaaagaaaacataggggtaaggctgcgtgacactcgtcttagcattgattttttttttggatatgaacccaaaagcacaaaggaaaaaatagacaaatggaattgcatcaaagtaaaaaacttctgcacagtcaaggaaataatcaacagagtgaaaagaaaatctacagaatggtagaaaatatttgcaaaccatatatctggcaaggtgttaatatccaaaatttgtaaggaactcaaaacaactcaatagcaagaaaataaccttatttaaaaatgggcaaaggcaacaggtatatgaaaaaatactcagcatcactaatcatcagagaaatgaaaattaaagccataaagtgatatcatttcaccttctccccagttaaaatggcttgtattaaaaagacaggcaataacatgctggtgaggatgcagagaaagaggaccccccccacacacaccgttggtgggaatgtaaattaatacagctactatggagaatagctggaggcatcatgctactcaaaaaaactaaaaatagaacttccatatgatccggaaatatccaaaagaaaggaaataagtatatctgcactctgtgtttattgcaacactattcacaatagccagaatatggaaccccccaagtgccaatcaatggatgaagaaaatacagtgtatatatacacaatggaatattagtcataaaaaagaatgaaatcctgtcatttgcagcaatatggatagaactggaggccattatgttaaatgagcaaagcacagaaagataaatatcacatgttctcattcatatgcaggagtttaaaaaatggatcttgtgaagatagaaagtagattggtggttaacagagaccaggaagggggaaaggggagggagaagatgaagggaaaaagagaatataaatgtatttattaccactgaactgtacacttaaaatggtaaatgtggtaaattttatatttatattttacctcaatacatttttaaatggtgaagaatctgaatagacattgcataaaaggagacaaacaatggccaaaaagtatatgaaaaatgctcaaaatcactatcagagaaaagcaaattaaaaccacaatgaaagatcatgtcacacctgttagaatggttattatcaaaaagacgaaagataacaagtgttggagaggatgtagagaaaagggaatccttgcacactgatggtgagaatgtaaattagtatagccattatgaagaacagtttggagtttcctcaaaaaattaaaaagagaactaccatatgatcctacagtcctactactgggtgtatatccaaaggaaatgaaatcagtatgttgaagaaatatctacactgccaggttcattgcagcattattcacaatagccaaaatacagaatcaacctaagtatcagtgaatggaggcataacaaaaatgtgaactaggtattgaaggaacatacctcgaaatcataagagccatatatgacaagcatcatactgaatgatcaactacaatggtattggaagttctagtcagggcagtcaggcaagagaaagaaataaagggcatcaggaagtcacactatccctgttgggagacgacatgatcctatatttcaaaaaccccccagtctcagcccaaaagcttcttaagctgataaacaacttcagcaaagtctcaggatacaaaatcagtgtgtagaaatcactagcattcttgtatgccaaaaacaagccgagagccaaatcaggaatgaactcccattcacaattgccacaaaaagaataaaatatctaggaatagctaactagggaggtgaaagatctctacaaggagaactacaaaccactgctcaaataaatcagagatgacacagacaaatggaaaaacattccatgctcatgggtagcaagaattaatatcactaaaatggccatattgtccaaagcaatttatagattcagtgttaaactaccattgacattctttacagaaataggaaatagactactttaaaattaatatggaacgaaaaaagagccataatagccaaggcaatcctaagcaaaaagaacaaagctgaaggcatcatgctacccatcttcgaacaatgctacaaggctacacagtgtggtaccagtacaaaaacagatacatagaccaatggaacagaatagagaacccagaaataagactgcacagctacaactgtctgatctttgacaaacctgacaaaagcaattgggaaaggattccctattcaataaatggtgctgggataactggctagccacatgcagattaaaactagatgcctttcttataccatatacaaaaattaactcaagatggattaaaacgtaaatgtaaaacgcaaaactataaaatccctggaagacaacctaggcaataccattcaggacgtaggcacaggcaaagctttcatgacaaagacaccaagagcaattgtaacgggcaaaaattgacaaatgggatctaattaaactaaagagcttctgcacagcaaaagaaactatcaacagactaaacagacagcctacagaatgggagaaaatttttacaaactatgcatccaacaaaggtctaatatccagcatctataaggaacttaaataatttacaagaaaaaaaaacataaaaaagtgagcaaaatacatgaacaaatatttttcaaaagaagacgtgcatgtggccaacgatcatatgaaaaaaaactcgacatcactgatgattagagaaatgcaagtcaaaatcacaatgagataccatctcacaccagtcagaatgtctgttggtaaaaagtcaaaagataagataccggcaaggttgtgaacaaaagggaatgcttatacattgttggtgggagtgtaaattagttcaatcattatggaagacagtgtggcaattcctcaaagacctaaagatagaaataccatttgacccagcagccccattactgggtatgtatacaaaggaatataaatcattctcttatgaagagacatgccatgtatgttcattgcagcactgttcacaatagcaaagacatggtggaatcaacctaaatgcccatcaatgatagaccagataaagaaaatgtgatatatataccctatggaatactatgcagccataaaaaagaaagagatcatgcctttgcaggtacatggatggagctggaggctgttacccttagcaaacctaacacaaaaacagaaaaccaaataccacatgttctcacttataagtgggagctaaatgatgagaacacatggacacatagagggaaacaacagacactgggtcctgttgaaggttggagggggtaggaggaaggagaggatcaggaaaaataactaatagttaatgggcctaatacctgggtgatgaaataatctgtacaaccaaaccctcttgacgcaagtttacctatgtaacaagtcagcacatgagcacccgaacttaaaacttaaaaagataatacggtatatatacacaatgaaataccagtcagctttaaacaaagaaggaaactctgttatttgcagcaacatggatgaatttggatgacattatgttaagtgaaggaagccaggcacagaaagacaaatactacgtgatctcacttatatgtaaatctaaaaatggtaaactcatagaagtaaagaatagaatggtaattaccaaataatatggtttagctctgtgtccccacccaaatctcatgttgaattgtaattcccagtgttgaaggtggggcctggtgggagatgattggattatgggggtggtttctaatggtttagcaccatcctcctagtgctgtctcatacagttctcatgagatctgattgtttgaaagtgtgtagcacctcccccttgttctctgtctctcccctgcttgctatgtgaagatatgcttgcttccccttcgcctttcgccatgattgtaagtttcctgagggctccccaggcatgcctcctgtacagtctgcagaactgtgggtcaattaaacctgttttcttcataaattacccagtctcaggtagttctttagagcaatgtgagactggactaataaccaaagctgggaggatgtcaatcaaaggatacaaaatttcagctaaataggaataatttcaagagatctatcatacaacatggttactactgttaataacaatgtatcctattcttgaaaattgctaagacagtagattttgtgttttcactacaaaataatgaggtaatacatatgttaataactcaatttagccattccacaataaatacatattttgaaacaacacactgtaaatgataaattgtacaattttatttgtcaatttaaataaatgtaaaaaagaataaaaaaacaagaataaactgtatgaaaacagaatgctgatacaagaaaaagctgttagaattttaaaatgtaggtaccaaaagctcagcataagacctggaaactaaagttgaggatatctttcagagagaaagagagagagaaaaagaagatggatatagaggaccacttcaggaattttaatatctaactaattggagagtggggaagaaagaaggggaaaagtggagagaaatcatcaaataaaataatacagaatcattttgcagagctaaaatatataagtctttggttaaaaagagccactgaggccaggcacagtggctcacacctgtaatcccaacactttgggaagccaaggcgggcggatcacttgaggtcaggagtttgagaccagcctggccaacatggtgaaaccacatctctactaacagtacaaaaattagccgggtgtggtggcacgtacctacagtcccagctaatcgggaggctgaggcagaagaattgcttgaacttgggaggcagaggttgccgtgagctgagattgcgccagtgcactccaccctgggtgacagagcaagactttctcaaaaagcaagcgaggccgggcacagtggctcacgcctgtaatcccagtgctttgggaggctgaggcaggtggctcacgaggtcaggagatcgagaccatcctggctaacacagtgaaaccctgtctctactaaaaatacaaaaacattgccaggcgtggtggcgggtgcctatagtcccagctactcgggaagctgaggcaggagaatggcatgaacccgggacctgggaggtggagcttgcagtgagccgagatcacgccactgcactccagcctgggcgacagagcaagactctatctcaaaaaaaaaaaaaaaaaaaacactgagtcctgacaattatgaatttctttaagacacatgcataaacatgtccttgaagttttggaaaaatgtagataaagagactaggatggtattagattctcattggcatccctcaggaaatggatttgaacttagatttctgtatcttgctaacctagtaattaggaatgaggttcacataaacctgattcctggacattcatggactgagaaagtttatctcctttataagttacctctttgcttcttaaatggttacttgcatatatactgcagcaaagtaagtaaaccaagaaagaggaatacatgagacctaagacacagtggattcaatccagagaagtaatgaagggcagcatcaggataactgaagagcagccagttcagaagagagaaggtggtaaaattcctccaagcaggtcttctccatgatgggggagagggaggcaaggagcaactccatgcaatacagttacatttgagaataagggggctgggcacagtggctcacgcctgtaatcctagcactttgggaggccaaggtgtgcagatcatgaggagatcgagaccatcctggctaacactgtgaaaccccgtctccactaaaaatacaaaaaattagccaggcgtggtggtgggcgcctatagtcccagctactcaggaggctagggcaggagaatggcgtgaacctgggaggcggagcttgcagtgagccaagatcatgccactgcactccagcctgggtgacagagtgagactccatctcaaaaaaaaaaaaaaaagaataaggaaacaaggctatgatgaagcctgtgtcaataagttaaacaaatggaagaacattccatgctcatgggtaggaagaatcaatatcatgaaaatggccatattgcccatggtaatttatagattcaatgacatccccatcaagctgccaatgactttcttcacagaactggaaacaactactttaaagttcgtatggaaccaaaaaagagctagcattgccaagtcaatcctaagccaaaagaacaaagctggaggcatcacgctacctgacttcaaactatactacaaggctacaataaccaaaacagcatggtgctggtaccaaaacagagatatagaccaatggaatagaacagagccctcagaaataatgccgcatatctacaaccatctgatctttgacaaacttgacaaaaacaagcaatggggaaaggattccctatttaataaatggtgctgggaaaactggctagccatatgtagaaagctgaaactggatcccttccttacaccttataccaaaaattaattcaagatggattaaagacttcaatgttagacctaaaaccataaaaaccttagaagaaaacctaggcaataccattcaggacataggcatgggcaaggacttcatgattaaaacaccaaaagcaatggcaacaaaagccaaaattgacaaatgggatctttttaaagtaaagagcttctgcacagcaaaagaaactaccatcagagtgaacaggcaacctatagaatgggagaaaatttttgcaacctactcatctgacaaagggctaatatctagaatctacaatgaactccaacaaatttacaagaaaaacaaccccatcaaaaagtggacgaaggatatgaacagacacttctcgaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacatgtatgtttattgcggcactattcacaatagcaaagacttggaaccaacccaaatgtccagcaacgatagactggattaagaaaatgtggcacatatacaccatggaatactatgcagccataaaaaatgatgagttcatgtcctttgtagggacatggatgaagctggaaaccatcattctgagcaaactatcaaaaggacaaaaaaccaaacaccgcatgttctcactcataggtgggaattgaacaatgagaacacatggacacaggaaggggaacatcacactctggggactgttgtggggtggggggaggggggagggatagcatttggagatacacctaatgctaaatgacgagttactgggtgcagcacaccagcatggcacatgtatacatatgtaactaacctgcacgttgcgcacatgtaccctaaaacttaaagtataaaaaaaaaataagactctggaggggtgcatgggttctatactaatgtgtttttcaaatgtgtttcagggtgtttctcttgttgtggatatgtcaggaaatggttgtgttcacctttccagcttaaggaaactcgtcaaagctaatgaaaattgtttccataatttttgtgtaaataaaaatgatttctaatttcatgaaaaaaagtaaattaaaaacaattagaaatgccaggaagaatgaaaaaactatataagacagccacgatctaaacaagaagcagaataaaatatggtatgattatgaacagctgatgcagttagaaaagacagtttaacctcaatgtcagaaacaatctcctttgaacattccaagaccctgatgctggacctacacataatgaaatacgttcctcatagattgcctgacctgacattcaaccatatttatataatcaaaatatcacaaaaacattttagtttatagcatctaaaatcactgtgtggataatctatagaaaattttattgtggttgtagaacagtatgaaaaaaacctgcacaacataaaagtcaaaatattgccaataaaatatgaaggtaaaagggagaagagagaataaggatgggttgatattatcctatgtaaaaggaaagtaaggaactatgatgaatgaaaattagatggataaatacaagttttgcagcttacaaagataatcaaccaaagaactgaacatcataacctcaaatattgggataggggagtaaagtaggacagtacaaatgagctaaatccacatgtttcctagcaaagaatcaatattttctaaagttgataaagtactaattataatgtagtttttaattacatttttattaaatatatgtttagttatagagataaccagcaaaagacctaaaagtgtaaatgattggaaagaagtggggctaaagatggaagggtggggtaggttagtagaatgtttgtttatataaatgcttgtatatgcttttgcttttatactgtgtgtatatataaattttttacgtttttattatggagaattttgaaatgcatacatactggtatagcaaagccttatgtacccctcacctagtcccagtaatgatcagaaattaagaaggcagagaataaaaaaccaatagcacttttaataaattgaaattttggttatgggaaaatattaacaaaaaccaacagctgactaatttgattaagaaaaaagggagaatacactaatatgcaaaataagaaataacaaggaggatctcgctctgtttcccagctggaatgcagtggcaccatcacagctcagtgcagcctcaactatgtgggctcaagcaattctcccaccttagcctcccaagtagttgggacaacagatgtgcaccaccacacccagctaatttttacattttttatagagacaaggtcttgctatgttgcctaggctggtcttgaactcctgggctcaagtgaccctcccaccttggccttgtaagtgctggaattgcaggtgaatcactgcacctagccagaagaaacttttaaaatcagaaaaggctactttgcagacacctaggaaaataaatgtgaaatcctagatgaaatggacagtttcctaggaaaatacataggacccaaattgactccatttgatttagaaaggtaaacagactagcttttatagaataaatacagatatttattacaaaactgcacaaaaaagcacaaagcccaggtagttttacaggggaattctgccaaaccttcaacaaccaggtagttcaaatgctccataaattatttcagagtattgaaaaggaaggaaaatttcaaactccttttatgaagcaagtataacactgatacctaaatcaggaaaagaccatccagagaataaaactgcaaacaaatatagcttcaagatgaatgataaaaggtaataaaacattaccaaacaatataccatgaccaagtgggatttattccaggaaggcaagattgttttaatattaggatatttattgtgttaagctgttcttgcattgctgtaaagaaataacagatactaggtaatttataaagagaagaggtttaagtggcttacagttctgcaggctttacaggaagtacggtgctggcatctgcttggcctacggtgaagcctcggagttttcaatcatggcagaaggacaagggggaagccagcatctcacttggcgagagcaggagcaaggtgtgggggagttgctgcacacttttaaacaaccagatctcatgagaactcactatctcgaggaccgcaccaagaggacaatgctagatcgttcaagagaaatccaccctatgatccagtcaccttccaccaggcccccatttgcaacactgaggattacaattcaacataagatttgccagggaaatagatccaaaccatatcatttattaatgtcgtatgttatatctaaggaaaaaaaatttctctgtattttagatactttcttaacatgatgaaatacatataccttagtgttaaagccaatatcttatttaatgggaaaacactagaggcacttcaacaaagatcaggaacaaggcaaggatgcccactatctccactactattcagcattttactgtagtaattgtataagagaaaacaattagaagcataagattggttaaagaagtaaaagtatcttgttgcagatgacagtaaagtttgaaaattcagaaaaattagtaataaaactaactcaataaaatattaaagtaggaggaaataaaattaacagaaaaatcaatagatttgccacttctgaccaagaaggactaacagggactggatttaccttccacttgcaacaaatggaaagtaacagacaggaaatataaaacaatgggttttcaagatggtgcacatcaggcaacaaacgagtgattcattcctgagagacagaaacaaagtgagtcttaggattgagagagcgtaccaccttgagaaagttttctagtcatagtgcaagaatgggaaacccaggctgagttaagtggactccttgagtttaggagacagagcctaagggtctaagagaaccaaggtgactagaattctctggacagagtaccaaagaggagagaactgcatggagaacaatcctcagagatcttcagaagttcctccatgagtattcagcagagtactgatcagcaaatagatgaggaaactaaccaaagctgaacaatatatggaatcaacctaagtattagtgaatgaaggcataaagaaaatgtacacaatgaaatactattctagtagtaatgggcacctttcacacccagatttggtttcaaataccattttccaatgaaaggagccagggcttcttagacaaaaggttcgtataccagagctggggcaaggaaaatacaagataaacatgggtcatcttatgccagaaaatatgaaagtccccataaaaacacaggggcatatcaagagaacacaggtggccaggctcatgcctgtgatcccaacattttgggaggcgaaggcaggcagatcgcttgagcccaggagttcgagaccagccagggcaacatggtgaaaccccatctctactaaaaaacaaaaacggcatggtggcacacacctgtagttccagctactcagggggctgaggaaggaggatcacttgaacctggaaggtagaggtttcagtgagccaagatggagtcactacactccattctgggtgacagagtaagaccctgtctcatttataaaaagagaacacaggagccaacctgaaggagctcctaatggccaaagctacatcaatttgagcaacaaaatgatgatagtataggattataacccatagaatgaaataaatacccatgagtctgcgctgttaaaaaaaagtaaataggccgggcatggtggcacacgcctgtaatcccagctactcggaaggctgaggcaggagaactgcatgaacccaggaggtggaggttgtagtgagctgagatcgcaccactgctgccctccagcctggatgacagagcaagactccgtctcaaaaaaataaaagaaataaataggagagaagagacagctcttccttatagaagatttccagttaagaaatgtagacagaatagaaacaaaatcactattaagtaaacactacagtgtaaatgttgcaggcataatctaacaatagatgctaaaatgaatgagagaacttttgaggagaaataggatattgacactctcaaaagcgtctgcctccatgatatttatctattattaagagaaaatagcaactttacagtggagaacgcagcagacaccacttgaactaagtgtgattaaagttaacatcaccaaatgaagacataccaacatcacataccctctgtattacgtatgcccagtgatgcactgaaaaggactcatcacttctgtggttctcctgccaaaaatgtgtaaccttaatcatgaccagacatcaaacaaaaccaaatggagagacagtctacagaataactgaccaaaactcattaaaagcatcaaaatcgtaaggaaagactaacgaactttcacagattggaagagaccagtgagacacaaaagctaaatgcagtgtaagatcctggaacagaaaaagacattagtggaaaaactagtgagatttgagtagtttcatatcttatccatgttcattttctggtttttatcactatactattgtttgtgacttgttaccattaagggaagctgggagaggagcataggaaatttttctataataatttttgtaagtataagattatttccaaataaaaagttagccaggcatggtggctcatgcctgtaatcccagcactttgggaggcctaggggagtggatcacttgacaccagtagttcaagaccagcctggccagcatggtgaaaccttgtctctactaaaaatacaaaaattaacctggtgtggtgcgacatacctgtagtcccagctactcaagaggctgagggatgagaatcccttgaacttggagaggcagaggttgtcataagctgagatcgtagcactgtactccagcctgggaggcggagcgagactctgtctcaaaaaataaaaattatgtaatatgtataataataagcctaaaaaaagttaaagaaataagtccattggtttgagactatgtattggtattatagctaactgctctgaagaaacagaagagatatacttgatgtctgtctgttgatgacaagccagttaatagactatatctgtaatggcatagctatttcctctggttaattaatattgtgattatctctattagatcctctgggctcattcagaatgctttaaaaatctaattagaaaataaaaacagtattttcaggttttaatattccaatagtcttcaatgagaacaagattaaagatttaaaaataaataaaattctaatgtgagaaatgatttatccacacaattatgataaaatctgatgggcattaactggcttgcacagcttaacaaagattcaaactacttgactacatggctgctttttttttccaaaaagaattttccatgtttttagattatgaaagaggatcattttcattggcttgcatctactgtccacgacatcctttctgtgtaaatacactttacataatacctcgacaataatctgtgggatgaattgccttgatgtgctgttgatgtgttagaattacagtacatacctcggagacatttgattcacaaattacctaacgtagctaaaatcaaacttcaactttttttgaagtatgctgtgtatacagaaaagcacacataagtatgcttataatgaaacgaatttaataaagaattaaattttaagtgcattattcattattgtaaaatagcaagtttgctcaactggcaacatacaggaaggaaaaacttccataggcataatttttgtatgtttgttaatttagttttggttttgatctttttcaggatgtggtggatacccaccctggtctcacgttcctgaaagatgctccagaattccactcccgctacatcaccacggtaggctgagtcatcttttttcttaatataactccataagtcacctttttattaccatctgctatccagaatttcaagtatctatgcaaaaggtaacatgggttataatgattatttcaagtggaaggaagctaaaataaaattgaattcataatttcttcatttttatctattttccttcttgtttgtgcccaatacttacaaaattaaagtaatatattccttctatctggtcttatgaggcatatctttttctgtgttatgaatattgatatccagttgatatttagcatttccaaataagactgaaaagaattttcaacagtctgtccctgtcccagaaaaaaagattggtctctagtacctcaaagttagaactggacatgataatgagaaaatagcttgtgtgtaatcagaaaacgatgtaagaatttaaaacaacatgatcacaatctcattttgtgaggagctcgcactccctgtttctcaggcacagcctcatttggtcagtcccagttaggtcaggaattataagtgagcacacacaggcccacagggcacggagtagccatttcatgcactctgctctagctcccacattatctttggagacattccaccgaccagccccagggccattcaccagacacattctcaagtgagatggccctggcatgtagctcagattcctcagctaaacagggccgtctcctctgaggaccaccctcctatacttagggtacagtttgttagccaaagatatgttaggtcctgccgagttacaaaatactactgttttctttttctcctgtaggaactttatttttcattcagtgcttttgcattggctctcttatgtcagtataaaactttgtaagattttatttgagccagaaggtgtcactgttatctaagacaatctcagaagttattttttcctgttaaccgtgacactctactaaattacctctaccacaatcaacctggcctgtcgccctgatatcaaacttggtttatttttaattggtctccctgttaccactctaattgccccatagtctagcctccacagagcaaacaattgtccttttaaaaaatcagccagatcatgtcactcctctgctcaaaccctgcagtagtttcccagctcacatagaataaaagccaagtccttgccaagattctccataatcctcccataccctggcaacccctattctctcatcttatctcctacctcccactcattttcttactctgcttcagccaccatgagcaaaccaaacccacttctgcctcacatgctttgttcttcctctttcctttgcttggaatgttcttcctacagatttccacattgtcactccctcacttcatccagatatctgctcggttcccttatttagtgaggccctccctgatcactctctgtttttgtaacccttcttcctctgccccctccccctacactctattcctttgtcctgcttcatttttcttcttagctcctatcatctgatatttaattttttgtttgtccatctcctatcatctgataaaatttaattttttgtttgtccatctcctgtcatctgatatttaattttttgtttgtccatctccgtctctataatataagctccatacaagcaggaactttgtctatgtcctcagtacctagaatattccctggcatataatagacagtcaatatgtactgagtgaatacatgaaattatccatgtttaagaattctaggccaggcacagtgactcatacctgtaatcccagcactttgggagcccgaggcagacagattacttgaggcgagacattcaagaccagcttggccaacatggtgaaaccccgtctctactaaaaatataaaaattagccaggtgtggtggtgcacacctgtagtcccagctactcaggaggctgaggcacgggaatcacttgaacccaggaggtggaggttgcagtgagctgagattcttgcccctgcactccagcctgggaggcagagcaaggatctgtctcaaaagaaaagaattctacgctagctctggctgcagtcccaaagagaattattgggttctgaatattgactattctgaaaactcagggcatattaacagcataatttagattcttaagagttagaaaagatcttagaaataaactagtccaaactgttggaattaaactagtccaaactgttggcatgtattcttagatattaaagaacaaaagagtaaaatggaaataagttttctttatggttctagtttgatatttcttttttttctttcatgatcttaatgaacgcatagtttgatattttttgaagtacttggacattcgatggtatttggtcacctagcaagtagtccttaggaagttttttggtttttgtttgtttgggttttttttgagacggagtctcactctgtcactcaggctgcagtgcagtggcacggtctcggctcactgcaagctccacctctcgggttcacgccattctcctgcctcagcctcccaagtagctgggactacaggcgcccaccaccacgcccggctaattttttgtatttttagtagagacggggtttcaccatgttagccaggatggtctcgatctcctgacctcatgatccgcctgccacggcctcccaaagtgctgggattacaggcatgagccaccgcacccagccatccccaggaagttttatgattttagagtgaaaagccatgaaaccattttgttcacatataattcacattttctgagaaatagcgtcatgttaataatagttgaacaaaatgaactacactggcgaattaatagagtacagttaattatctctgctgtaatattttcatggcatttgtatgtaactttacatttgttaaatttcactttgttattaacattgtgctgctttatctccaatgcacaaaagtgaatccattactcagaactagccatttaagtataaaatacttgtgataaaatgatgataatatggcaactcaaaacagcaccataacataaatagtaaacaagacctaattgggaacatttcacgtgaatatgtactgagataagtgaataactgccattgtgataaactcacaaaaagggcaaataaaaagtataaaaacgattatctggaaatagaattgtattagactggttatcttctcctcagtgccttttctgttatgaaacttggtcaaataatggcatgaagtcattgaaactgttgcattatttcagagtacagtgagtttttctagaacaaatgtaaaataaggccttctagtatgaaattaattttgttgttagacataaaagtgaccaaattaaaaagacatcgttctctaccctgctcacagcaaaaacagttaagatcacactatttctaagaaacatataaagatcagcctcagaattaatgacagatatctcagaaaaagcaaaatcagttaccatgtgactctattgaatgttatataatcttcgtggcatacagtatagaagaacaattaatatgtttgcatgctagtgttactcagttctttcagtttgcatttggaagaaaccactgacatagagtgtgatccaagtattagcttatgtgaggtacatatatgatgaaggaaagttagaaaacttttattttctatgtatcattgaaaatctatgttacaggaaaggctgtttgtttagttaattattttgtcagctgtttttagactggaaagacagaccatcagctatttgtacagcaaagaaggacatcattacccaaaaaaagagattgaacctaaagtcagtctgtattcttatttccaaaaagatttagaagttgagaaataagcctttgatattgaatgaaaatgaagattagaaataccagcaaatcatagccgttgagtgcagttttgcatgctgtgcaaaaattgccagtgaataaaaggttttgcttatccaaaccaacatatgccaacttttgaggaaagaagtgctaacttgagtttttaaaataagcgatgagatttaaaatacttctttatgacactggtgctggcagtagagatatttctgtggcttgctccaatggtgtgtcttagtgatatattcagtatcttgattggccagaatccaccactgtaggctgaaatgccaggattttccttgtggagggcaaggtactgattttcctaagatgactaagctatagtggagactgctcacactaagagcttaccaactcttcccccttgaaaacttttcctcttaagagagaaaaaaaaatttttgttagatatattttttaaagtcctaactctacagaagaccataaggaaatacttttctgagccatgttaaccaaagagtgaattagaaatctgttcaccactcctgccaagtgagagccaggcttccagcattggagtttgttcttctgtacacatacatagtaaaaattatttgtaacttctatgtctgtatttaattcatttttcaaaaactatatgacagagccatcaaacatttccattcctggtgacctatacttgtgaattagagatttctaattcaatagataccaagaagaaaggaaactgacttacaatttaacttatatatcaagttgactaaagatcccttggtgaaaaatggtcagatttcatttatttcactagcagaaaatagttattctaattatgatttattgtaaaattttatttgatattttaaatgatgatgaattttatttacctagaagagagcagttagaaaaacaataattagtgtagagtcagcagctacatgcttcaccactagatggtgctcctgcctcagccatctaaagtgctgaatcagtgatgtggaaaccaacaaatgtgctgatgaagtgtggccactgaataaggagatttaggctatggaaaaatggaatacaaatacattgtcttatagtattagataagtaggttagcacaggctaaaaataggaaatgcctaacagtcaaactgtttgcagattttaaaaattcaaaaagaagaggagaaaaataagcacgaatggatacagattataaagttttataatttttaacacagtaatttcataaataatataaagtatttgagtatataaatataaattttagatagaaaactcatactttaagataaatttacattcagaatcaagaaataaggacaaaaatcttcaatagaaaaatgtggtttaataatatatattgaaattgactttaacttgagagaggggacatggaattatgataaatcaaattcttaatgtttattttcgtacataaattttctgtgctaaaaatcctccatcgtttttacatgaacttccgccaagctagtgctaagaatacagtattgagtaagacatgttctctgtcctcagtgacctcagagtctgagtggttggggccagtagagaaattaggcactgcctagtcccagctcccacctaattcaggaatcctgtcaacttcttcctaaatacttgtggtgaaaagatgaaaagaaacccagccacttcatacaaactcattgctttatagggctaattttaggaaagtcttccttatattgaagcatttcagtataaatgcatttctgtctagcagttgtaattcttccctttggtgaaacacagaacaagtcagcttcttcttccgcccaatagccactcagatcttgatcacatctacactctagtcttattttttctcaagattaaacattactacattagtagcatctttcacaatcattttgaatatagttacacttacctgttttgtggtttttgcacattatatatgattctatctataaataatagacaaaaatactgatatatgtgaaatactaattagagacctttcttgggttgacattcatctgctatgcaaaactctgagtagagttcttcaaatagttatgaagccaacccgtatttctctaacacaaagataatacaaaaatctttgttatgtaactttcaaacctcattattttatcaagcagttatggaccacctgatatatagaaagcaccgtggctgggcgcggtggctcacgcctgtaatcccagcactttgggaggccgaggcgggtggatcacaaggtcaggagatggagaccatcctggctaacacagtgaaaccccgtctcaactaaaaaacaaaaaattagccgggcatggtggcgggcacctgtagtgccagctacttgggaggctgaggcaggagaatggcgtgaacccgggaggtggagcttgcagtgagccgagattgtgccactgcactccagcctgggcgacagggtgagactccgtctcagaaagaaaaaaaaaaaaaaagcaccatataagttactggaatacaagtcaagaaagacctggtctcttagtgtttggaggtgatgatggtcaggtgcaccagcgtttggaatgtaaccacagggacagctaaaggaggctcaggtggcagtgggagcacagaaggcagagctctagtcagtccctgtcctggggcctcccatggagcgtggcacttgagctcaattctgtagggtcagaggggttagcactgatagcaggggtggggtagtgagcgctggacagctgaaatctagaccttcatcctgatgctagtttttccctgtttagaacagttgaagaatcactctctctgctgaagaatccagaaaagaaaggtggtttagtccctcattaggcctactattgagaaagatgtccaaatatcttgccttatttgttcttctcgcaccaaaatatcttgaaaaagagatctaatttcttccatgataaaaccaccaaagatacaggatttctgtattattagactatcaaaataaaagcagaatgcacccccccacccacccaaaaaaataaagctgctcaaattgctctttttaccactgcttcctttgggagaagaaaaataatcagtgaaagggaaatgaagtgggtaggaatgactgcaggtaaaattgttaagaatgcactgtgacctcctacctccaggattgcagcttccatcttccttctctggtcttctcctacaccacagcacacacatcctcaatctagacacatttgcttcttatctcctcttctcccattctatccaaggttttctccagagttgcaattctgctaaacccattaaaacaccagctaataacaaagatgttcatgcccaaataaaagttaggatataaattatcccagatgtatttgaatttccatagagtctagaagaccgagagtcttcaagactcaagtgaataaggctataataaccagaataaggccctcttgaatcataccaccttgatagccacccttctgaccagttaatcaatcattaggccaacccaggagatacttcccacctcatatgccttcccaaaacattgagccccataagcattacttgaatcaggcatcactgtataaattagaggtaaacaaaagaagtgatgtgaaggcagttgggaagtgaagacttgtgagcagagaattttttttattcttcttggaagtacagaggcaaatccaaaatatatagatgtagatttaaaaatacagtgctgatttttactaggaattacacttaacataatcaaaaagctaaaagttaaattggtcccaagtatgttcataaaatggcctttgagaaagtagtggagatctttaatgtttttatttggttttattttccttttggaaccaggttattcagagaatattctacacagtcaacagatcttggagtggaaaaattacttcgacagagataagaaaaagcaactttttgcaagtatgcctttcattagaattcatgtgtaatgagcaatttagataattttcttactttatttaacaaatatttgagcgcttactctattcaaagcactgtcactactttcagtcattaagcatttatcaaatacctgtcgtgggatgctggaatgttttgggtgagggggtaaaaatgaagagaataataagggatctctgcctgaaggcatgcactctggagcaaaagagtgaagtgtacagacactaaacctgacttgataaattccatagacatggataaaacgtacagaggcggcttcacaatagataagcctggaggggtgggctggggctaggttgggaagggtcttggaaaggccttggaagattttaaacttgatcctttcagcaatgactctgtatccagcacctgctagagaaaagtactaaaaattccttttaagaaagaatacatttcattcaattattttattcatattaccaaatgagagagaaagtattgaccactagtgggagccttttaccgaagtaatcttcatgcctgattgtttaagcttctgtaaacataaagtgaaattgttcacacttggaagaaaatgaaatgttttatttttaagaatcatactaaatggaatttaggctaataatacaaccttacttactctttattttttcctatcttcatctgagacagagtaatgaagacttggcaaaattagcagtccatgatggatatacaaacatttttttattctaaaatgaacagtcatcatcacagtcagtgttgatatttattgaacacctgatgcctgcctgggctctcagtaggtaatatgggatgggttaaaatggcagtaattccataatacctcaagagtaatgatgataatcccccactttcctgaagcacattataggttgtagtttctgaatcatttttataatccataattttttttttttttttttttgagacagagtcttgctctcttgcccaggctggagtgcagtggtgcgatctgggttcaccacaatgtccgccttctggattcaagtgattcttctgccttagcctcctgagtagctgggactacaggcgtgtgccaccatgcccagctcatttttgtatttttagtagaaatgggatttcactgtgttggccaggctggtctccaactcctgacctcatgatccacctgcctcagcctcccgaagtcctgggattacaagcgtgagccaccatgcctggcctaatccatattttttcttttttggcttttaaaattaatccttttttttttttttaccagtgataaaatttgaggcccaaatatacttaaatgatttgtataagatcacacaaaagtaagttgctgaactggaaaaagaactcaagtgttctgcttcctagagcatgatttattttctcctcgctttccttccctgcccctttccttagtcttcctcttcgtacttaaacaatactcataaaacattcaaataatatgagcacatctagagtaataaacagaagtcactattcttcactctaccattttaccccctttccccagagggggacccatatcatctgtggttttattctcttatatacatgtagtatatagttttgttttgtatggctgctattttgagggttttcaaaaaatatatgggttcatactattctcttaacttggttttttcacttaacagtgtctcagggtttttttcatttccattcatataagtctatctcattctttcaactactgcataatcaattccatggctaaagtgtaattaattacatattcctctattgatgtccaaatcgttttcagatttcctctattacagtgatgcagtgaacatccttgtatggggtatgagtaagaatgtctgtagaatagaccactggagggaaaatcctggatcaaatagtatgtgcatttttaatttggtggattctgccaagttaccctccaaaaagcctgcactactttcacttatatactcaccaacaaaagttgctgtcgtcttcattttatgccaatccagtgggtaaaaataatagcgctttgcttctaaatatgtgctttattgaaagtgttctgcttcttacatatcaaaggacattttataaaacaaagtaatatgagcaagtttggaagacagaagaaaaaccatattttatcacccttatacaactagtatcatttttgtctgtattcatctagtcttattcatatgtatatatgcatttttaggattttatgtagttcttagtgggtacaatcttgtatcctatattttgtacttaccatatcatggtcttcagtgtaaactttataatttttactagctgcataattttctatccagcagatttaccataacttaataataatttatgttgttgttagtttgccagagcactttggttttccagtgtttatattttaaaaaataattttttgtcagaatactaacatttgtgttatgaaatagtcctctttgtccctcatgtgtttcttttttcttttttttttctttgagacggagttttgccctgtcgcccaggttggagcacagtggcgcgatctcggctcactgcaacctctgcctcccggtttcaagcaattttctgcctcagcctcccaagtagctgggattacaggcgcctgccaccacacccagctaatatttgtatttatagtagagacggggtttcaccatcttggccaggctggtcttgaactcctgacctcatgatccacctgcctcagcctcccaaagtgctgggattacaggcatgagcaaccacacccagcccgcttatgtttttcaccttgcattccatattaatattgatacctgtttatttttgttaacatttaaccgtgtatgtttgtccatcttttttttaaccttccttattttttttagatgtatcccttatagatgcatataggtagatctgttttgggggcatggttttgatacttaatcaaaaaaatattttaatagggagatgtatcacttatctttattgtgactattcatatatctgattttatttctgccatttcatttttttatatttcttacattcttttgtgcttttatttttctttctgaatctttcacttctgaatatgtctttatttatctgcccacttacataataatttggctgacaacagaattgtgggttcagtatcattgattctggattttgccgtaggggagtacagtgagtcagggaagacccaggtttacttccagctcagggccctgcatctctacctgccatgcctatgccaggccaccatgtatcatcactattgtatatatgagtaacctttgtgatataaacttaattttattacaaaatgaaaccctatatgttgatgcctacccctcttaatgttgctcacataactttgaaaattaaaaacagtatttgtttctggccaaataattaagactatgatctaattgttcttttcatgccagtctctgacctctgaccaactatagtccccaaggtaatggtacttcccttcccctgcttttacatcctccacagcatccagcccttcactgagcatattacagagctcagtaaatgcttatagattgattggttgattaaaggtaggatgaggttgcctattaaagggtttctgatttggtaccagaaaaaaattttaaattcagtttaaaacagaaattcgctagactctgcacagtggccaaagctgctttttcataatgtttaaattcttcttttcatataatttcagaccctagcacttttggaagaagaggaagatataaaccaaattacagattacttctcctatgaacatttctatgttatttattgtaaattctgggaactagatactgatcacgacctctacatcagccaggccgatctgtctcgatacaatgaccagggtaagtgattctgtagatgctaagacttaaccattttaaagagttatataaattatcactactcattatgagaaattcccgtttgctaaattctaaacctaatcaagtcctctttacaggccaataatttttaagaggggatgagtgaagataatataattttttattaaattaataaaaggccagatgtaggagaaggagtttggaagtaagtaaccaatcacagtcttagttttgataaagcgatgagtctttatactggtgtgtattttctgatgatgaattgaataagatccacacctgtttaaatctgtttgaaagagaatatgtatacacctttataacccttcccacttaacaatatttctgtaaaaagccaagcatgaaaataatgtttttaacttgccaagttttattttcaaggactcacaaaaatttacttttggaaattttgttccagaaagatacgtctctgcagatgaattttgcgtgctttcttttgtcagaaaacaaaaaattacatatcacatgataataccctttttacttcatttttgccagcggtaaatctagaacctgttgcctactgatttaatatccttggtttttttgagacagcgtctcactttgtcacctaggctggaatgcagaagcatgaacacggctcactgtaacctcaacctcctgggctcaagccatcctaccacctcagcccctaagtagctgggactacaggcacatgccaccatacctggctaatttttttgtatttttttgtaaagatggtggtatggtttggctatgttcccacccaaatctcatcttgaattgtagctcccataatccccacctgttgtggcagggacctggtggcaggtaattgaatcatgggagtgggtctttcccatgtagttctcatgatagtgaataagtctcatgagagctgatggttttataaaggggagttcctctgcacatgctctcttgcctgccaccctgtaacatgtgctgttgcttctcctttgccttccgccatgattgtgaggccttctcagccatgtggaactatgagtccattaaactcttcccattataaattacccagtctcaggtatgtctttactagcagcatgagaacagactaatatagtaaattggtaccagtagcatggggcgctgctgtaaagatacccgaaaatgtggaagggactttggaactaggtaataggcagaggttggaacagtttggagggctcagataaagacaggaacatgtgggaaagtttggaacttcctagagacttgaatggctttaaccaaaatgctgatagtgatatggacaataaaatccaggctgaagtgatctcaggtggagatgaggaacttgttgggaactggagtaaaggtcactcttgctatgcaaagagacttggcattttgcccctgccctagagatctgtggaactttgaacttgaaagagatgatttggggtatgtggtggaagaaattcctaagcagcaaagcattcaagaagtgacagtgcataaaagtttggaaaatttgctgcctgataatgcagtagaaaataaaaacccattttccggggagaaattcaagcccactgcagaaatttgcataaataatggggagtcaaatgctaatcaccaaaacaatggggaaaatgtctccagggcatgtcagagaccatcatgacagcccctcccatcacaggcctggaggcctaggagggaaaaatggttttctgggccaggcctggggccccccctgctctatgcagcctctgaacatggtgacctgcatcccagctgtttcagctccagccatggcttaaaggggccaacatacagctcaggccgttgcttcagagaatgcaaaccccagcccttggtggcgtccacgtggtgttggttctgtgggtacacagaagtcaagtattgagatttgggaacctccacctagatttcagaggatgtataaaaacacctggatgtccaggcagaaatttgctgcaggggcagagccctcatggagaacctctgctagggcagtgtggaagggaaatgtggggttgaagcccccacagagtccctactgggacactgcctagtggagctatgagaagagggccacaatgctccaggccccagaatggtagatccaccaatagtttgcaccatgcacctggaaaagccacagatactcaatgccagcccatgaaagcagcaaggaagggagctgtaccctacaaaggcacaggggtggacctgcccaaggccatgggaacctgcctcttgcatcagtgtgccatggatatgagacagagtcaaaggagatcattttggaactttaaggtttaatgactgcagtattggatttcagacttgcatcgggcctgtagcccctttgttttgactgatttctcccatttggaacaggtgtatttacccaatgcctgtatccctgttgtatctaggaagtaactaacttgcttttgattttacaggctcataggtggaaggaagttgggttgtctcagatgagactttggactgtggacttttgagttaatgctaaaatgagttaagactttggggggactgttgcgaaggcatgattggttttgaagtgtggggatctgagatatgggaggagccatggttggaacaatatggtttggctgtgtccccacccaaatctcttattgaattgtagctcccataatccccaagtgaaatgggagggaccaggtaggagttaattgagtcatgggggcgggtctttcctgtgctgctctcatgatagtgagtaagtctcatgagagctcatggttttagaaaggggagttcccccacacacacccctgctgccatgtaagatgtgcctttgcttctcctttgccttccaccatgattgtgaggcctccccagccatgtggaactgtgagtccattaaacctctttcctttataaattacccagtctcaggtatgtcgttattagcagcgtgagaacagactaatacagatggggtttcgccttgttgcccaggctggtctcgaactcttgggttcaagtgatccactcgctttggcctgccaaagtgctaggattacaggcatgatccaccacacctggcctgatttaatattaactaagcactaagatacattgattcattcttctctcataagattgtccctgttctgtccttaaatgccttctcaggcactgttgatttttaaatgatactttagcttattagatatagcagagtatgaatcttaaataaatgcattgaattttgtttttgttttttggtatggctgttactaatggtatgcatcttaagaaaaggctcatcaggcagggggcagtggctcatgcctgcaataccagcactttgggaggccaaagcgagtggatcacttgaacccaagagttcgagaccagcctgggcaacatggtgaaaccctgtctctacaaaaaatacaaaaattaaaaattaaaaaatgtctttcaaatgacaaaaatacaaatattagtcagatgtggtagcacatgcctgtagtcccagctactcaggaggctgagatgggaggatctcctgaacctggggaagttgaggatgcagtgagccatgatggtgctgctacactccagcctgagcgacagggagaccctgtctcaaagaaaaaaaaaaaggtttgttgtatatgatgtcaggtttcatagagctttgcgtatttaagaaataaagttggccaggcgcggtggctcacgcctgtaatcccagcactttgggaggccaaggcaggtggattactaggtcaggagttcaagaccagcctgaacaacatggtgaaaccccatctctactaaaaatacaaaaattagccgggtgtggtggtgcgtgcctgtaatcctagctactcgggaggctgaggcaggagaaccgcttgaacccaggaggcagaggttgcagtaagccgagatcacaccactgtactccagcctgggcgacagagcgagaaggggccactgaatactccataattatccactcaccagactgtccctaatgagacaacatagaataacatgatcttcaattttaggaagctaaaccttcccaagctaaaaaatgcctttaaaaaaagattttggctttacaattaaatatccttgcctttcctatatagccctctttttttctatctagtacaaattaaccccataaaccaatgttcagcaaaatatagaaggtctttatataagctttggtgtgtggccaggcacggctgttccaatacacatattcccaactttctttggccaaaccaatttacctttatgctaactgtacctaactatgtgcagaagaattcgatgctgatagctgctaagtccctaatgaccttattgatgatcctgaaattttagtgtgcatgccattgcctggggcatctgttaaagaacaggctgggcatggtggctcacgcctgtattcctagcactttgggaggctgaggtgggcagatcacctgaggttgtgagttcaagaccagcctgcccaacatggagaaaccccatcgctaataaaaatacaaaaaaattagccaggtatggtggcgcatgcctgtaatcccagctacttgggaagctgaggcaggagaatcacttgaatccgggaggcggaggttgcagtgagccgagatcacgccattgcactccagcctgggcaacaggagcaaaactctgtctcaaaaataaataaataaatgaaagaacaggtctctagtcgtgtctctctctctctctctctctctctctctctctctctctctctctctctctctcaccaacatgctaacttaagccacgattatctatgtgaataaaacttcctgatggaatttctaaaaatcttatgttatatcatgttaaaccctgggcttttataaaatgggaatataagaaaagtatgtttgtagtgtgtttgagtagcttttaaaaaaactacttgaaagcattctccattgttttaacttcgttttgttttattttacattgttttaggagcttacacaatcagttctcccttgaatttaaggataaaacttgtcttgtttataggaaaattggtctcattggataagatcaaaacaaatcctatatatttttgtcctagctgtcaggatgttcagacctaacttagcattcaactatattaatacttcccagatgtcagccacattcatttgcctgttattttttaaaattatattaaaattatgcgtaaataaaaatgtactcacattctcatcatggacgatggttacggtttagcttgtagctagtgaaaagcaaatttgtgaaaagtattgcctttatggagcatgtttctaactagctttgcaattttttttttatctacatttagcttcatcaagcaggattattgaaaggatattctctggtgcagtaacaaggtaagaaaacgtttaatgctgtgtttaaaaatgaactacaagtaataccataaccatctcattttagcaaagcttcctgaataatttggcagtgctattggaccaaataatatcctataaaacatagttatggcttaatacaagacagtaattcttttttaaaaaaataatttcaacttttctgattcagggggtacacgtgcaggtctgtcacatgggaacactgggtgatgatgagatttggtgtatggaggatcctgtcacacaggcagtgagcacaacacccaacaggcagtccctcagccctcactgtgctcactccctacccacttcagcagtccccagtgtccattgttcccatctttatgtccatgtgtactcagtattagcttccacttacaagtgagaacatacggtatttggttttctgttcctgtgttaattcgcttaggatgatggccttcagctgcctccatgttgctgcagggacatgatttcataatttttatggctgcatagtattcaatggtatatatgtaccacattttctttatccagtctactgttggtaggcatctaggttgattccatgtctttgctattgtgaatagtgctggataaacatacaagtacctgtatctttgtggtagaatgatttattttcctttgggtatatacccagtaatgggattgctgggtcgaatggtagttctgttttaagttctctgagaaatcaactgctctccaccacagctggacccatttacattcccactaacagtgtataagtattcccttttctccacagcctcaccagcatgtgttacattttgacgttttagtagttgacattctggctgttgtgagatggtatcttgttgtggttttgatttgcatttctctaatgatgaatgatgttgagattgtttcatgtttgttggctgcctgtatgtcttcttttgagaagtgtccgttcatgtcctttgcccatttttaaatggggttgttttttgcttgttgatttaagttcgatatagagtctggatattagacctctgttggatacatagtttaagaatattttctcccattctgtaggtaggtagttaaatctgttgatagtttcttttgctgtgcaaaagctctttagtttaattaggtcccaatcatcaatttttggttgtgttgcagttgcttttgaggacttagccataaattatttgcctaggctaatgtcaagaagggtatttcctagggttttttctagaattgttatagtttcaggtctgatatttaagtctttaatccattgtgaattaattttttatatggtaaaaagtaagggtctggtttcattcttctgcatatagctaatcaattatcccagcactgtttattgaatagggagtctttttcccgttgtttgtttttatcgactttgtcaaatatcagatggttgtaggtgtgcagctttatttctgggctctctcttctgctccattggtctgtgtgtctgtttttgtaccagtaccatgctgttttggatacagtagccttatagtgtagtttgaagtcaggtactatgatacctctcgcttggttgtttttgcttaagattgctttagctattgggactttgtttttggttccatatgaattttagaatggtgttgtttttttttttttcttaaaaaaaaactagtctgtgaaaaacgacattagtttaataagaataacattgaatctgtagattgctttggggagtatggctattttaacgatattgaatcttcctatccatgaccatggaatgtttttccattggtttgtgttatctctgatttctttcagcagagtgttgtagtcctccctgtagagatttttcacctccttggttagctgtattcctaggtattttattttgtgtgtgtgtggctattgtaaatgggattgcattcttgatttggctttcagcttgaatgctattggtgtattgaaatgttactgatttttatacattgattttgtatcccgaaactttaatgaaattattattagttctgaaagcgttttggcttagttttcaggcttttctaggtatagaatcatgttgtcagcaaagagagataatttgacttttcctatttggatgtgttttatttctttctcttgcttgattgctctggctaagacttccagtactatgttgaatagagtggtgagagtggtcatccttgtcttgttcttgttcttaaggggattgcttctagcttttgtccattcagtataatgctagctatgtgtttgtcataacggctcttattattttgaggtatcttccattgatgcctaacatgagtattaatcctatatctaaatacaggtaacagcattttatcccagtgattatttgcattcatattaaaagccagatttcttttcttcatatttgcaaatgccttctggtttcaccctctagacctttgaaaataagataggctgtggaagggttgccctttatgaggcatttagcattataatttaaaaaattttaactgacatactactttatttcttagcctatcatcctgataaatggttctgagtaattgctcaggaaattttataaccatgtgttttctttaggggaaaaacaatacagaaagagggaagaatgagctatgcagattttgtttggtttttgatctctgaagaagacaaaaggaatcctaccaggtatgatttctaagtttcctttgccaagatgttaaacacatgcacaaagcttgaaaaagtcatggtgtatattatacctagtgaggccaactcaacgtggcaatactaagatgaattagacttagtttctgccgtctcggagctctccgtctcaggagattggcactgaatccatgttcatggcatatcaagagaagtgctgttacccacagaaacaaaggtgaagtgacatgtaagctgatgacaagtagggctagtaagcattcatgtggaatatgggaatagatgctatgaattacttgttttatcatcttactggttgaatggtaaaccattactattagagagggaaagcaaattgtggatgactagtatataagaacacatcctcagtctgccagttgaaatcatctatgcttttccttggcactcccagacatagcttgattggagttattaatttacacatttctttctttccatgtcttgtttaggcaaaaaatctagatgcctcgcttcttatccctactttgtgtaacacaacgcactgtagtttgtgctcagtaccaagggatggaggggttatagaccttgatggtacttgcaggtacagctaactcaactatcttaatattgattcgaaaagttatctaaatgttgtatatgtccaggtatggtggctcacatctgtaatgccagaactttgggaagccaaggcaggagggattgcttgaggcctggagtttgaaatcagcctgggaaacataacgagactccatctctacagataaatgttttaaatagctgggaatggtgatgcacacctgtagtcctagctactcgagaagctgaggcaggaggatcacttgagggcaggagtttgaggctgtagtgagctaggatcatgccattatactccatcctgggtatagtgagcaggacaccaactctaaaaaaataaatgttgaatatattgtttagaagatgttgaaataaaaataagccatttcttggagagcttgttagattatttttaaataactttgttttccatttcaaaagtaataatttatttagaaaacatgaatgagcagaagaaaaataaattttaataccagtaattttaatacccagaaaaaaatattaaaagttcatatatatgctactctttttcatataccagcagagtagagtatctcttatctgaaattcttgagatcagaagtgtttcagattttggatttttttcagattttgaactgtttgttacacttaccagtgagcatcccaaatctgaaatccaaaattctccagtgagtatttcctttgagtatgagttttgagtgtcttgttggtactcaaaaagttttggattttcagctgggttgcagtggctcacacctgtaatttcagcactttgggaggccgaggtgggcagatcacctgagatcaggagtttgagaccagcctggccaacatgatgaaaccctgtctctactaaaaatgtaaaaaattagccaggcgtggtgatacatgcctataatcccagctacatgggaggctgaggcaggagaattgcttgaacccaggaggcagaggttgcagtgagctgagatcgcaccattgcactacagcctgggtgacaagagcaaaactccatcaccaaaaaaatatatatattaaagatctaaatgaaatgaagacatcccatgttcatggatcattgttaagatggcagtaattcccaaactgatctacagattcctaacaaaatattagttagtttgagtcaaaagctttttttgtttttcgatggtttttattttttttccagaaatggaaaagctgaatattaaattcctatggaaatacaaagggaccacagtaaccaaaacaatgctgaaaaagtacagaaaaaatgtaggactcatatttccctattccaaaatatttcactacaaagtgaaagtaaacaactctgtgtggtactcgtatcatgatggacataaaaataaacaaaattgaattgagagttcagaaatatatcctcacatttagggctaattgatttgcaacaaggatgctggatgccaggacgatccaatggggaaaaaaaacagtgtttttaataaatagtgccggaacaactggatatcatacaaaataatattaggttggtgcaaaagtaattgtggtttttgcaatttcttttggtggccaaaactgcaattacttttgtaccaaccttacctttggacccctagttcacatactacaaaaattaagtcaaatggatcacagcccaaaatgtatgagctaatgctataaaaaattcagaagaaaatagaggagtaaattttcacgaccttggctaggcagtttcttagatgtgacaccaaaagcataagtatcaaaagaaaaagtcaatgaattggacttcatcaaaattttaaatttttggctggatgtgatgactcatgccagtattcccagtactttgggaggccaaggcaggtggattgcccaagctcaggaattcaataccagcctgggcaacatggtgaaaccccgtctctaccagaaatacgaaatgtaaccaggcacagcggcacgcgcctgtggtcccagctacttgggaggctgaggtgggaggatcacttgagcctgggaggcagaggttgcagtgagttgagatcacgtcactgtactccaacctgggtgacagagtaagacctcatctcaaaaaaaagaaaaaattaatacttttgtgcatcaaaagatatgatcaagaaagtaaaaagacaacccacagcatggaagaagatatttgcagatgatatatatgataaggaacttgtatctagaacatataaacaacacttacaactcaataatagactgaccagtttaaaaaatggacaaaggatctgattagatgtttctccaaagaagatatatgcatggccaataagcacatgaaaagatgcttgacatcattagtcatcagagaagtgcaaatcaaaaccacaatgagataccacttcacactaggatagttatcaaagagtcagataataacaggtgctgccaagcaggtggaaaaatcggaaccctcatacattacaataggaatgtaaaatggtgcagccgttacagaaaagtctgacatttcctcaaatggttaaacatatcatatgacctagcaattccactccttaggtatatactcaagatatatgaaaacatgtccacacaaaaacttgtacacccattttcatagcagcgtcattcacaatagccaaaagttgggatcagcccaagataaacaaatgtgatctattcatataaccaagtattatacagcagtaaagagaaatgaaatactgatacatactacacacgactggatcttgaaaaccttatgtaaagtaaaagatgccagtcacaagacaccacatactgtatgaattcatttatatgagttgtccagaatagacaaatgtatagaaacaggaaataggttaatggatgcctaatccgtggagagcctgtggtgaaatgaggaatgagtgctaatgggtatggagtctctttttgtaggtgatgaaagtgtccctatattaattgtagtgatggttatacaactctgtgaatgttaaaaacccttgaattgtacattttaaaaggaacaattatatgatatgtgaaatatattttggtaagcctgtttaaaaaaaagacttagaatactagaaagtatgttctgtaaacaaaatggaattaatgtagaaatcaatatgagaaagacaactggaaaatctccacacacttgggtattaaacaacacacttctaaataatctatggattaaaaaggatgactcaaggggaattagatattcacgaagtaataaaggaatgctacaaataacgtatacatacacagatatggtgacctcaatgaaatggaccaatttcctttaaagtcacaaattaataaaactcacctaaaaagaaatacataacctgaatagtcagatgtctattaaagaaaattgaattcacagtttagaacctcctgaaaaagaaatctcccagccctgataatttaattgtattcttacagtcatttgaagaagaaataatactgaattctgcaccacattttccagaaaacagaaagggaaggaataattcccaactcattttataaacaaaaccagacaaacacataccagagaataaaactacagactgacatccctcttgaatatagacccaaaatcagtaacaaaatactagtaagtcaaggcttagttcctcaaactttcaggtccctcttccagaatctgcagatgccccaagggaaagatggtcccaaatgctaggtgcccctctctggattttcttctagatctggataccataattcttcactgccctgttaattctccagcatctttgaactgttttttttttctatggggggaggtcccctcagtttcctcagtggaaggcatgatcccacttaggtaatcattagcagaagtggagctcttcagatcagtttttcacatcatgagatccataactggattctcatagaatgttaccaacaaaggttttttgagtcaaaagctttcttagacctcctttggtgctccttttctaccttgcatgttgcctttctcctaacagctcacatattgagattccattctttgccagtgactagtattttatatgtaatggcttatttaatcctcatatcactatgagttgaggtgtcagtggtcccatttttcagttgatgaaacagaagctctaagagactgtgcagctagtaagtgtcctagcttggattcagactcaggtttgtatctctcccaaacctggactctaccactatatggcctgtcatccagatgccattcatttgcatgtctaccttctttccaagtaggctgtagactccctaaaagagagttctttttgtgtcatgaaattgcttgttgcttaagagaatcaaaattaggccaattatataagaaaataactactgattttgcccattgatacttgtttccttggtttctagtggcacttactaggtaccctgcatgttattctcagtggttcacattgctttactaaagcagagtgtgagcagaaaatagtgtccaccattttggcaaaaatgtcagtacagatgctcctccacttacagtagggctacatcctggtaaactcagcatcacttgaaaatataagtcaaaaattatttaatacacctaacctactgaacattataccttagtctagccagccttaaatatgctcagaacacatcttagcctacatttgggcaaaatcatctagcacaaagcctactttataataaagtattgagtatctcatataatttattgaatactgtactgaaagtgaaaacagaatgattgtattggtacttaaagtgcagtttctaatgagtgcatgtggctttcaccccattgtaaagtcaaaaaattctaagtcaaaccatcataagtcagggactgtctatagaatgaaaatcaaactcttatttaagaaaatggaacaggcaccactttgcagaaatggggtttctggcttatgaattacatgggttgaaaaaatgaatttcctaaaaaaagtaatacattcactaaggtgtgattaatcctgcgtgaaatgctgcgtacgaaattaggatctagagtctttcctatgcctggtaacagaggtagatatgggaagaatctgggtagattgttttctgtggacaaactcttgcaaaccctcttttagtatgtcctttaatctctctgtcctggtttttatcatattctgcttctaccttagtcatctggctagatatcatctccaggagctatttcattcacctttgttatgcctaagggcactaggccagtgcttttcacagtagtaaataataaaatatgtatattgaatatgcaacagaatatacatttaattactgcctaagcaataatggagtttccagtaactttcttcttgagtagcatacaggagtttatattaggggtaagaaatcacttgctcagcacttaatttcattcagtccaaggaaaggacaagaagtaatcttagctcatggctgtagtcccagctacttgggaggctgaggcacaagaatcgcttgaacccgggggttggggaggaggtgaggaaggttgcagtgagctgcgatcatgtcactgcactccagcctgggtgacagagcgagactttgtctcacacacacacaaaaaatgtaattttgtttatgtctacaatattagaaatataatttgtcattaatatcattatgctttgaaaaaccaaatattggtggtaaatatagcagaaatctaacactagtgctctctggtcagttattccttctgtgttttctgttttccaattttcctacaataaatagtcaatacttttaggctctgagaagatcagttacctttggtaagaaaaaaaaaaaaagaatctgcaatgaaagaaactttagagagtatccagtactttcaataagaaaataccctctgaacatgtcctgcatgtattatccatccagcccctgctgctaaacttttcagggacaagtaactatccactgaggcagcctgttcatttttctctttcgttcattgatccttatagtctccaatattcagagaattatatctgtttgatctaccacatctttcagatatttaaaagcagttatgtgcttttggcaaatattcaggcagtatatctatctttgcattctagctttctttctctcttacgggctattaacaaagaactgaagggtatgctttagctttatttattgtaaagagaagattgtcttagttcttaattgaaaatgcaagtaattaaattatttcagtttctatttcacagtaaaataagttgtctttcacttcagtcctgttaaatccttggtcaaaatcaagatttactttattcccttttgcctgattttggttctcttaagataattaatgaggaatttcaagacacaaagagatcttagaggccagaggccactcccctgccccttttgtactgaaaccattattacttaaaaaaaaaagtcccaacagtgtaacaaccagatattattacatgtattgcagccctctgcttatgagatgtaactcttcaaggttttccccacaatcaggaatagtttgacagtggggcagcattctgccccttttatattctgagagtagatatgatatgactgaacctcaccatagccaacctattacctcacattcattaggttcaatgaatgtccccctttgttctttaataataatgttaaacatcaagttggtacaatttttaaaatatatttctcaaaaagactttgcccactctgggcaacataggaagacctgatctctacaaaaagtttttaaaaaattagccaggtgtggtggtacatgcctctggtcccagctagtctggaggctgaggcaagagtctcacttgagcccaagaggttgaggctgcagtgagccatgattgcagtactgcactccagcctgggtaacagaatgagagcctatctcaaaaacaaatagtaaaaaacttttcaagtattacatgttcaattttttgcaataatgtaaactatatctttctcagaaaaggtacacacagatcttaatgtgacttacttgaaaacagtcaacagttacaacttagttattttcacttttctctccccaaaggagattttcttttaaccattaaaggtgtggttcttaatatggtttcaggcctacaagtgggaatttgaacagcggtctcctagaaccttctcttgaaaagttttactttgccatgaatttgtggttctttagaaaaacattgttccctattaccaattaatgttgttggcttcataaaggaaatgagaaataataacaaagtattggaaactggaaagcaaataaacatagcagactgcctgaatcctaagccagctgagggaaaaaccaagaagcaaccagatatacccagcaaaacctgcagacattcaggatttggggatactaggaaccttggaagtgggggtggggtaaaggtaaagccaaaacaggagagtttatagaaagtttgtttaaatgaacagttgatcttcaggtcatgtcctctaccctagcataaaactggtgctttattccctggagaacataaaacagagggtctccggactggggagcattgggcacagttgagatgtgaatgtgatcttgaaaacagataaaatgagtgtatgcatactgaatgctgagacgcccagtcttcattcctcactcagctaacagaatgctgcctacctgccctgaacctccaagcaagaaactgaaatgcttttctggggaactgacctgcccaagaataaagacctgaagattcgacactgggtcatccccaaggaaaaaaaccagcccattcattttacagtaaagcccagagtcaacaaacccacagatcagaacctccaatcagctttttagcacctactctcaaatatgagcagagaacagaggatcactagatacctgagtaaagcctcttgcacaaaagataaaggccagacaaatagagggggaaagataacttggatgaaacagactttcagagaaaataaaacattacaagaaaaaaaacacagtgattaatatcctcagagagactatgagaagaaattagagtacaggacatgaacagaatgatactttctatgaaaggaacattcaggaaaccaaaaagctctttgagtaatcaaaactacaatagcagaaataaaaaaacaatgtttagaagataaagctgtgtaaccctcccagaaagaaaccccctcccccaaaaaagatgaaacaataggaaatagagacaagatacgaaaattggagaaacagatcaaaaaaattttaatataactggaaaatgaaatatggtacaggccacataggtaattttaaaatttagccacaatggaaaaatttaaaaataggtaaaattaattttgttgtatatctgttttgtatttgcactgagaaaacatctcaaatttgattagccacatttcagatgctcaaaaggccacatgcggctagtagctataccattactgggctatgtagatctcaataacagttcttaaaaaaaaaaaaaaaagagaaggagggaaagggcagggaagagagatacaaacattttcaaggactgaaggattcagtttccaaactgaataggctctcagaaaagcccagccaaatagatgagctagatctcaaccaaggccatcatgatatttcaaactactaaggactcagagaaacctctgcgggcttctaagaggcaaaaaacaaaatgggttacagtcaaaggaatagataccaataaagctttagacttctcatcaatactggataaacaatggatcaatactttttaaagtatgagggaaaaggccaggcgcaggagctcacaactaaaattccagcactttgggaggccaagacaggaggatcccttgaggccaggagttcgagaccagtgtgggcaatatagtgagaccctgtctctaccaaaaaaaaaagaacttttattattattattattaaaaattagccaggctaggcgccgtggctcacgcctgtaatcccagcactttgggaggcctaggcgggcagatcacctgaggtcagaaattcgagaccagcctggtcaatatggtgaaaccccgtctctccttaaaaaaaaaaaaaaaattagttgagcatggcggcaggcacctgtcatcccagctacttaggaggctgaggcagaagaatcacttgaacccgggaggcagaggttgcggtgccaagatcacaccactgcactccagcctgggcaatagagtgatagagtgagatgccatctgaaaaaaaaatttagctaggcatcgtggcatgcacctgtagttccagctacttgggaagattgcttgaggccaggagttcaaggctgcagtgagccatgttgtgcctctactccagcctgggcagcagagtgagaccccatctctaaagttaaaacaaaaaatctgaaggcaaaacaccacaaacctctaattctataactagccaaaataccaaccatattagagggtagaaaaaaggcattttcaaagacccaagatctcaaaaaatgtacctgccatgctctttcattcaagaagctactagagaatgcgcagagtaacaaaataatgaggaaacaaagaatgaggaaaatgcaagaaacaagaattaggagaaaggcgaaaggaatccctggatgaaactgagcgaggcctagagactaagcagcccagattagagtaggtcagaagcaaccaaggaagacttcatcaagaacatgcaattgacagagcacctcatggaactgagtgtggatttagacaactggcagaatttgggggttgaattagtagcaagtacacagaaaactaagcaaatagataaaagaaaaatataaaattataaattctgaatgttgagcaagttaactgtgttaagaggatgagaagggcgtgtaggtaaagtggtgacaaattacagaagaactaaagttcaactttcataatgtgaaatctactttttgtttggttggttggttgtttagttggtttttatcttgaggcgggagtctcgttctttcacccaggctggagtgcagcagcgcagtcttggctcactgcaccctccacctcccaggttcaaacaatcctcccacctcagccgcccaagtagctgagattacaggcatgcaccaccatgcgcagctagttttttgtatttttagtagagatagggtttcaccatgttggccaggctgatctcaaactcctgacctgaagtgatctgcccacctcagtctcccaaagtgctgggattacaggcatgagccaccgtgcccagcctctaataatagttctgaaaataaatacaagaaaggagcgatatagacgtgttatctgaaaataggaaggtaaaaagcaaaatggggttgaacacggttgattctgggtggaaaaataaagggaagaaggggtccgccattttctctaacaaactttgtaaaactatatctaagcctgaagtgtatgtaatatgtaacttttactttaaaagaaacatactaaatctggataaataaaaggtctttaccaggcccatgataatgattgtccttatcatctagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggtgagaccaagcaatgggacagatgcactgttcacctatgtatcagaggagggcaaagaatcctagattgtcctaaattatttaacatttcagagtcttgatagaagacttcctaggacagaagtgtttaaagtttctccttgactattagtgtagcaacttttttttttttttttttttttgagatgcagtctcgctttgtctgccaggctggagtacaatggtgtgatctcagctcactgcaacctccgcctcctgggttcaagtgattctcctgcctcagcctcccaagtagctgggactacaggcaaccaccaccatgcccagctaatttttgtatttttagtagagatggggtttcaccatgttggccaggctggtctcgaactcctgacctcaggtgatccacccacctcggtctcccaaagtgctggggttacaggcgtgagtcaccatgcccaggcttagtgtagcaattgatggcaagtctgctatttaagaaataggattttacaccaggcacagtggtgtatgcctgtagtccctgctactaaggatgctgaggtgggaggattgcattatgattgttcctgtgagtagccactgcactccagcctaggcaacacagcgagactgtatctcttttttaaaaagaaaatgaaagcggggtttgggggatgaaagaagatttttccttagacacagaaagcacatgaggagagatgggagggactgcttgatgggcacagagtttccttttggggtgatgatattattacagaactagatagtggtaatggttgtacaacattgtgagtgtactaaaagccactgaattatgcactttaaaattgtttaaatggtgaactttattagtgaattttacctcaataaaagaaatgggtttgagaaattgatacccttgaaaaaagaaatgagatttaaatttttttattctgaaaataggacttttataataaacatatacctatacttttagatgtcagggaaagttttttcctcttgccaaaacagctcttgatgaaatttaccagatttgtttatttttatgtaggcaaaataactctaagagatctgaagaggtgcagaatggctcacatcttctatgacactttctttaatctggagaaatacttagaccatgaacagagagatccctttgcggtccagaaggtaacagtataattttaacttttatttgagggctgcagtgtcaggggctgtgtgtgctacatattaacatggtctctgcatgctggaatttcggtaaagaggtaacatttgtaacatttcattaaagactaaaaagagacaataaaggacctctagagcacatgtctctccacagccgatcgtcaggtctaagtaacctgcatctgtgtaagcactttccactgagcggactctatagctcatctactgatacacacactggaaacaaaagagtagttttgaaaaaaaaattgtccttctaacttttaaaaatatatcaataggcacatctgtattagaaactatattggccttgattcacttgtaccattcatttccaggattccatggtaagtagctttccccatcacggtaaaaactagagttctccatgatagaaaaccttcaaataatataacgccttttcacgtgttaatgattgccgttcatggctatcagttttgaatgcattctacatctgaataaagctgaatatccttccccagacacacaaacctgtggaccctcagaaaaccctatacatacgatccatgttaaaaataaaaacaatgtcaccccttgttcttaccattcctctaagaagtaaaaattatgttaagaacagactgttgcagttgagtaacagtaaactataagaagcttttgcattcttttttcttctgcatgttccataactgtttgacctaaatagtagtaagaatatgatcaccttctaaataagataaataagaatttatcgccttccaaaaacaaatattctgcagctgacctcagcatatcaagttgcattatcgctggcttaaagtctgttatggttcattgaatttaacatgctccataattttatatttgtttctttctttgtgtgtgtgtgtgtgtgtgtgtgtgtgacagagtttcgctcttgttgcccaggctggagtgcaatggtgtgatctcggctcaccgcaacctccgcctcccgggttcaagtgattctcctgcctcagtctcctgagtaactgggattacaggcatgcaccaccacacccagctaattttgtattttttgtacagacaaggtttctccatattggtcaggctggtctcgaactcccgaccttaggtgatctgcccacctaggcctcccaaagtgctgggattacaggcgtgagctggctgtgcccagcctgttttatagttctctaagcaaaaacaaaaccccaaacattgccagttgtaagcctataatgcattgcaattttataaatgttagaaggatagagatggggtcttaaaaggagttaaatatagtaattaatagtggtcattgtttaggaacttaacattattcttggcataactaactctagaccctagggcaatactaactcatgttcggcttggaaagacattttatctgaaacataaaatttcaagaaaattcacaaaagtgtgtggtcttttccctcttcacttattttctttgtgttaccatttttactctaaaaaaattacctttaaattttactttttttaataaatggtataattattgatatttgttctgatctacaaagaacattattagtcagtgcttaataaattctgggcactgtgttgaagagatactggatatatggagatggcagagatacaagaacaaaaggtggcaaccaaagtatctacattaggaaaaaggaagtgatatggagagaagggctgtttccaggaagctatcacagacagcgtggtatctgagttggcttttaaagaacaaaaatttgccagcgaatgggggcttggggaaggtacatttcaggcgggcctgtggcaaaccacaagtcactccaggtggctgctgtgcaaagtgccagaggagaggggaccagagaaatgtctctgattacaaggctaaagagtagacttaccaggtgctatggcttgtgcttgtaatcccagctacttaggaagctaagacgggaggatcacttgaggccaggggttcaagaccagcctgggcaacatagtgagcccctgtgtctacaaaaaaattttaaaattagcagggcatggtggtatgcctgcattctcaactacttagtaggtggaatgcctgtagtctcagctactcagtaggctgaggcaggagaatcacttgagcccagattctgaggttagcagtaagctattggtgcaccactgcactccagactaggcaacagagtgagaccctatctcttttaaaaaaaagagttggaatcagccagccacggtggctcacacctgtaatcccagcactttgggacgctgaggcgggcagatcacctgaggtcaggagttcgagaccagcctggccaacatggcgaaaccctgtctctacaaaatacaaaaattagctggacgtggtggtacttgcctgtagtcccagctacttgggaggctgaggcaggagaattgcttgaacccaggaggcagaggctgcagtgagccgagatcgtgccactatactccagcctgggtgacagagtgagattctatctcaaaaagaaaaaaaaagaaaaaagaaaaaaatggaatctatacctaaaaaacctggctgctaaacagttataattttgccatttgaggtgtagaaaattaccttaggagttttaccttagcacctcttttaaacctgttgaaatgaaacatttttcaggtaggattttttcagcagtatacatttgtgtgatgatctatctccaattctttgtctttgattttttttatttctcgtggctgtcttctttccaatcaggatgttgagaacgatgggcctgagccctcagactgggaccggtttgccgctgaggagtatgagacgcttgttgcagaggaatctgcccaagcacaattccaggaagggtgagtaagtttccctatgtcttatagaatttttaacaggaatgcgcatgtccagagtattaaaacccccttacaaaatccttttctgttttttccatttttgaatagcataaaaatgtgatttagccaactttagttaaatgattattttttccagcaatcttcactcatttcctgacagagtcttctcatgtccatttcctttaatgagtctcatctttcactggaaaccgagatcactgaacaatcaaactactgttttagtgatattgataaaccctgtacataaaggaggaggctaaaagaactaaagctctggccgggcacggtggctcacgcctgtaatctcagcactttgggaggccgaggcgggtggataaccagaggtcgggagtttgaaaccagcctgaccaacatggagaaaccctgtctccactaaaaatacaaaaaaattagccgggtatggtggtgcatgcctgtaatcccagctacttggaaggctgaggcaggagaatcggcttttacccgggaggcagaggttgcagtgagccgagatcatgccattgcactccagcttgggcaacaagagcaaaactccgtctccaaaaaaaaaaaaaaaaaaaaaaaaaaaactaaagctccttcaataataataaagatgatcatgtttagaacaaatctttattatacatggttttgtgcaggaagtaacttctacatgtatttctactagtcagggcataattccataaagggaccatgttaagaaatttaattatccaagaatttgactccttggatcacttcagcaactttataatttgctggttttttccatcatcttctagtaactccttttgtaattcttctaattcttccttagtcatagcttctgtaaaggcctcaattaatctttctcattaatgtagtgtactttttgaacaggcactattcatataatattcaaagaaacaaaagaaatagtaaaaagtttcctactacccacttctcctccccagaagcaacaagtgtcatcatgttcttgcttactcttccaaagagcctctctctccacctatctatgtatatttagaaagatacatgaattcttttttttttttttttttttttttgagacagtctcaaatgtggtctctgatgtggtccattcaggtcagcctcctgaggcatagagatagaggaagagcaggtctagagggataaacagaaactatccagccccatagataaagtcaaatagtcctcaatatagattgtaccattttatacctctaccattcattaaatattatcttttttgagggtgctgaacaagccatcagcaaagagctttctttcactgagagatttctttaacctgcttagccacaaaactaggatttcatttttatggcagtgacctggaaacccttaaaatcattcatcgtgcactcagtatcttaagcctgactgcatcagaatataggaaaatggattcacaagcatgatttaaaggtttttttggcattgagcttccatactaggaattagggttagcataccaatcttaagaagcaacaatgctgcagttaagaatatgtgtggattggccaggcgcagtcactcatggctgtaatcccagcactttgggaggctgaggcaaacagatcacttgagcccaggagttcgagaccagcctgggcaatgtggcgaaaccccatctctacaaaaaatacaaaagttagccaggtgtgatggtgtgtgcctgtagtcccagctactcaggaggctgaggtgggaggatcacttgagtatgggaggcagaggctgcagtgagctgagattatgccattgcactccagcctggcctgcagagctagctagaccctgacacacacacacacagcaagtgtggatgtttataatagtgaaaatttggaggcaatctaggtatctaatgggaagattaataaaattatactacatgtacccagtacagttccattaagcattaaaatcattttgtggatgtgtacttctggactttaattaggaaaaacgggatgaggaagaagactatgaaagatcaagtaaaatgtaatagaaaagaaacaaaaaaagtatccaaaagaaaattaggtataggtaaggaaagcaaatgggatcttatttatgtgttttagacaaaagaatatatgaaatagtaaagtatattaaaagacaataggaaagcttttttgaaataaaagaaaacctgaataggaaaggtcagaaatcacgccatatccaggaaatactgataatgaatagtgatggaccccagatttgcattgtgaatttactagaactcaaggatgaataaaggtttatcattgggttttttttttccagttttaaaaattcaagtcaccagacaactggtaaataaataaataaataaatcagcatgcctcagtaaaattgaatactgaaagaccatgaaacaatgtttgcaacttcctcagagaaagaagctctatacccaagaattttagaccaagccaagatggtattcaagcataaagatgctgatagatattgtcaaacatacgagaactagagattatatagtacccaggagctcttctttaaaaagtacataatcataaaaccaagagacaagccaaaataaaaagccggaaatgagcagccatggtagaaaagaaataatagtgagcattcaatccatttaaatgtagaaatgaggctaaacaactatgggcattaaaagagagcagaacataatattccataagaaaaaaatagtgtaactgaagatgtaaaaatgaggaagtaaatatatgtgtaagtttcattagcagggtctcaacagatgctctcaaaagctgataagttggggtttaagaaaattataataagctgttacaaaactaaagccagactaactattctaattaaatcagaaaacatgtacacacaaaagaaaaacacagaccatgcggcataaactaaagatgccagaactaacgcaaatatttctagatcagtgaatgtaaaaggaataaagtcacttatcaaaataaaaagattcaattattgaatgacaacaacaaaggttgaatataaaaataattaagacccccaaaaaaactgtcttgataacatcagatttttaaagcaaaaacaaaaaaggagaaattgaaacctattacttgaagacacagtaaagtattcccttaagatagataaaaatacctttgtggtttatgttcatagatcatttacaaaatacatattaggccacaaacaacacttcagtggacttctaaaaactagcattaatatagtaatatagaccagcattagactcagcatctgagttaaactgaaagtatgctatagttttcagtttcaaaccacataaaagtaagaaatacagaatatcacttagaagagaaactttcagcgggccactaaaagaaggaaagcagatgggatcaaaatgaaggagccagcagcttagattcttcatagtagaatgtataaaataattagacaggtaatgggagtagcacttaatgatctctacctgaatttgactgaaaccaatagcaagaagaagaccagaagaagatgtgtctaggtaggtcaactcctgtatatcccaccctacccctaaaggaaagacaaaagccctgactatggagcttggaacagagaaagcccagtcactgaaatagctacacctcagcaacatatcacatcccatctcattctgtccccaactcatatccctgttctcattaaaaaccccaacaaccccaccgccccttcctaagcagccagtgagaacagaagcagcagtctgttctcaactacttaaaaggtggacaaatatcaaacagttaagaaatatcaatgaaatactcaacaaatggaagaacttatacccttggaaggagacacaatcagaacaagacatcaaaatgagcatatttactattttcaaaggaataagagagaatatcacactcctaaaccaacactagaaccagtttcttagaaatgaaagttttattaaaaaaaaaatgcagccattggactgaataatagaatggaaaaaactgaaaagtttttgatttgggatactggcgtaagaaatcctctttggaagcaatagaaataatagcttaataattccgagaattttagttgtttgagcaaataaaaagatacacaggagaaggaatcagcaatttttttctaaccagttataaatacttgaggctttgtgggcctctgccacaactaagcagccattgataatatgtaagcaagtgtatgtggctatgttccaataaaactttagtaacagacactgagctattcatttcatattattttcatgtcacaaatattcttttgtttttcaaacttaaaaatgtaaaactatttttagctcacaggctgtaccaaagcagatggcaagataggtttggcccacagactatagttgtcaacctctgtgagtgaaatttcagaatacgaaagataggaaaggtctgaagatctaccagaaagaaaaaaacattatccataaagtgtacacaaaaagaaatggaacaaaattattcaagtactgcaaaaaaaataactacaaacctaaaattctgttcttactcaaatgtgagggacaaataaagacattttcaggcttgtaaaaagaggtgcaaaaagtataccacagaatatctctgaaacaaatattaaatgatattcttcagcaagaaggtaaatggatcctagaggaaacagtgggaggaaagaagcaattgtgagcaataaaaatagtaaaaattattcttaggactaaataagtattgatcacagatatataagagagaaaaaggaattggagtaatatcctatggttcttatttgtataagagtagagaaatatagacattgataaagttgtatttctccaacaatggttaaagtatgtctgttaaaaatttaagatattttcactagaagaataaaaataaaatggaaaactttcatatcagtttcagaaaaaggttattaactgaaaaaaattgagtaaaaactcaaactacttgaaagtacattaatcagcattcttctggtggcaagttacctaaactccgctcaaagtagcaataagccaaacttcttcatacatacaaactagaaaacttagaagaaattgataaattcctgaaaacatacaacctcctaagattgaaccaggaataaaccgaaacactgaacagaccagtaatgagttctgaacttgatcagtaattaaaaaaaaaaaactaccaatcagataaaaccctggactagacagattcacagccaaattcttccagatgtataaagaagagctggtaccaatcctgctgaaattatttcaaaaaatcaaggagggactcctctctaactcattctgtgaggatagcatcattctgatactaaaacctggcagacacaataaaaaaaacttcaggccaatatccttgatgaacatacacacaaaaacccacaacaaaatagtagcaaattaaattcagcagcacatcaaaaagctaatccaccacaatcatgtaggctttattcctgggatacgaggttggttcaacatatgcaaaccaataaatgcaattcgtcacatgaatagaacaaaaaacaaaaaccacatggtcatcttaatggacacagaaaaggcttttgataaaattcagcaccccttcatgttaaaaaccctcaacaaactggcatctaaggaacatacctcaaaataataagggccatctatgacaaacccacagccagcgtcacaatgaatgggcaaaagctggaagcattccccttgagacccagaagaagataaatatgcccattctcaccactgctattcaacatagtgatggaagtcctatccagagcaatcagggaacagaaagaaaactcatcaaaataggaagagagaaagtcaagctatccgtctttgcagatgatataattctatacctagaaaacccatagtatctacccaaaggctcctagatctgataaacgacttcagtaaggtttcaggatacaaaatcagtgtacaaaaatcagcagcatttctatacaccaacagcattcaagctgagagccaaatgaagagcacaatcccatttgcaatagccacaaaaagaataagatacctgggaataagggatgtgaaagatctctctacaacagtaattacaaatcactgccaaaagaaatcacagacaacattaaaaaatggaaaaacattctatgctcatggatagcaagaatcaatattgttaaaatgaccatgctgcccattgtgctcgtggacaggaagaatcaatattgttaacatgggcatactacccaaagcaatctacagattcagtgctattcctatcatactaccaacatcatttttcaaagaatttgaaaaaaactattacaaaattcatatgaagctgggcgcggtggctcatgcctgtaatcccagcactttgggaggctgaggcaggtggatcacctgaggtcaggagttcaagaccagcctggccaacatgataaaaccccgtctctactaaaactacaaaaatgagccaggtgtggtggcagacacctgtaatgccagctactcgggaggctgaggcaggaaaatcgcttgagcccaggaggtggaggttgcagtgagctgggatcacaccactgcactccaacctgggcaacaaaagaaaaaaaaaatcatatgaaacaaaaaaagcccgaatagccagagcaacccaaagcaaaacaacaaagccaggagcatcacactacccaattcaaactatactacaaggctgcagtaaccaaaacagcatggtgctgatacaaaaacagacacacagactgcgtggaacaagattatatggaacaccagtggaacagattagagaactcaaaaatgaagcacacctacaaccacctgttttttgacaaagttgatagtaagcaatgaggaaagaactccctattcaataaatggtgctggctaatcatatgcattagattgaaactggaccccttcctttcaccatatacaaaagtcaatgcaagatagaataaagacttaaatgtaaggctggccatggtgactcatgcttgtaatcccagcactttttgggaggccaaggcgggaggatcacttgaggctaggagttcgagactagcctggtcaacatggcaaaaccctatctctactaaaaataccaaacaaaaacaaaacagtgtggtagcacttgcctgtaatctcagctactcaggaggctgaggcacaagaagcacttgaacctgggaagtgaaggttgcagtgagttgagatcgcaccactgcactccagcctgggcaacagagcaagaccctgtgtcagaaaaaaaaaaaaagagagagacttaaatgtaagacctaaaactagaagaaaacctgggaaataacattctcgacataggccttggcaaagatttcatgatgaagtctccaaaagcatctgcaacaaaaacaaaagtagacaagtggggcctaattaaagagcttctggaattgctggcaagatggccaaataggagtagctccagtctgcagctcccagccagatcgacacagaaggcaggtgatttctgcattccccgctgaggtacccagttcatctcattgggactggttggacagtaggtgcagcccatggagggtgacccgaagcagggtggggcatcgcctcacccaggaagcagaagggatcagggaattctctcccctacccaagggaagtcatgagggattgtgcctgaggaatggtacactccggccagatactgtgcttttcccacagtcttcactacccacagaccaggagattctctccagtgcctacaccaccagggccctgagtttcaagcacaaaactgggcagccattcaggcagacaccgagcttcaggagttgttgttttttttgttttgttttgtttttccccataccccagtggtgcttggaatgccagcaagacaaaaccattcactcccctggaagggggctcaacccagggagccaagtggtctggctcagtgggtcccacccccacagaacccagcaaactaagatccactggcttgaaattcttgctgccagcacaacagtctgaggtcaacctggaacactccagcttgatgcagggaggggggtccagcattgctgaggcttgagtatgtggttttaccctcacagtgtaaacaaagcactgggaagtttgaagtgggagcgcaccgcagctcaccaaggctgctgtggccagactgcctctctagattgctcctctctgggcagggcatctctggaaaaaaaggcagcaactacagtcagggacttagagatgaaactcccatttccctgggatagagcatgtgggggaaggggcaactgtgggcgcagcttcaaaagacttaaacatccctgcctgatggctctgaagagagcagcagacctcccagcacaacgtttgagactgcctcctcaagtgggtccctgacctccaggtatcctgactgggagacacctcccagtaggggccaacagacacctcatacaggagagttctggctggcatctggcgggtgtccatctgggacgaagcttccagaggaaagaataggcagcaatctttgctgttctgcagcctccgctgatgatacccaagcaaagagtctagagtggacctccagcaaactccagcacacctgcagcagaggggcctgactgttagaaggaaaactaacaaacagaaaagaatagcatgtctactcagagaccccatccaaaggtcaccaacaccaaagaccaaaggtagataaatccacaaagatggggagaaactagtgcaaagaggctgaaaattccaaaaaccagaaggcctcttctcctccaaaggatcacaactccttgccagcaagggaacaaaactggacagagaattagtttgacgaactgacagaagtaggcttcagaaggtgggtaataacaaactgctccaaaccaaaggaacttgttctaacccaatgcaaggaagctaagaacctttaaaaaagggtagatgaattgctaactagaataaccagcctaaagaacaacataaatgacctgatggagctgaaacacacagcacaagaacctcgtgaagcatatacaactatcagtagccaaatcgaccaagcagaagaaaggatatcagacattgaagatcagcttaatgaaataaaacaagaagattagagaaaaaaagaatgaaaaggaacgaacaaagtctccaagaaatatgggactatgtgaaaagaccagatctacgtttgattggtgaacctgaaagtgacggggagaatggaaccaagttggaaaacactcttcaggatattatccaggagaactttccaaacctagcaagacaggccaacattcaaattcaggaaatacagagaacaccacaaagataccccttgagaagagcaaccccgagacttgtaagcgtcaaattcaccaaggctgaaatgaaggaaaaaatgttaagggcagccagagagaaaagtctggttacccacaaagggaagcccatcaaaccaacagcagatctctgcagaaaccctacaagccagaagaagaaagtggggactgatattcaacattcttaacgaattttcaacccagaatttcatatccagccaaactgagcttcacaagcgaaagagaaataaaatcctttacagacaagcaaatgctgagagattttgtcaccaccaggcctgccctaaaagagctcctgaaggaagcactaaacatggagaggaacaaccggtaccagccactgcaaaaacataccaaattgtaaagaccatcgacactacaaagaaactgcatcaactaacggacaaaataactagctagcatcataatgacaggatcagattcacacataacaatattaaccttaaatgtaaatgggctaaatgccccagttaaaagacacagactggcaaattggatagagtcaagacccattggtatgctgtattcaggagacccatctcatgtgcaaagacacatataggctcaaaagtaaaaggatggaggaatatttaccaagcaaatggaaagcagaaagaagcaggagttccaatcctagtctctgataaaacagactttaaaccaacaaagatcaaaagagacaaagaaggtcattacatgatggtaaagggatcagtgcaacaagaagagctgactgtcgtaaatatatatgcacccaatacaggagcacccagattcattaagcaagttctcagagacctacaaagagacttagactcccacacaataatagtgggacactttaacaccccaatgtcagtattagatcaacaagaccaaaaattaacaaggatattcaggacttgaactcagctctggaccaagtggacctaagcaacatctacggaactctccaccccaaatcaacagaatatacattctcctcaacaccacatcgcacttattctacaattgaccacataattggaagtaaagcactcctcagcaaatgtaaaagaacagaaatcacaacaaactatctctcagaccacagtgcaatcaaattagaactcgggattaagaaactcactcaaacctcacaactacatggaaactaaacaaccttctcctgaatgactactgggtaaataacgaaatgaaggcagaaataaagatgttctttgaaaccaatgagaacaaagacacaaagtaccagaatctctgggacacatttaaagcagtgtatagagggaaattcatagcactaaatgcccacaagagaaagcaggaaagatccaaaatcgacaccctaacatcacaattaaaagaactagagaagcaagagcaaacaaaaagctagcagaagccaagaaataagtaagatcagagcagaactgaaagagatagagacatgaaaagcccttcgaaaaatcaatgaatccaggagctggttttttgaaaaaatcaacaaaatagacctctagccagactaataaagaagaaaagagagaagagtcaaatagatgcaataaaaaatgataaaggggatatcaccaccgatcccacagaaatacaaactactgtcagagaatagtataaacacctctatgcaaataaactagaaaatctagaagaaatggataaattcctggacacatacaccctcccaagtctaaaccaggaagaagttgaatccctgaatagaccaataacttctgaaattgaggcagtaattaataccctacaaaccaaaaaatgtccaggaccagacagattaacagccgaattctaccagaggtacaaagaggagctggtaccgttccttctgaaactattccaatcaatagaaaaagagggaatcctccttaactgattttatgaggccagcatcatcctgataccaaagcctgccagagacacaacaaaaaaagagaatctcaggccagtattcctgatgaacatcgatgcgaaaatcctcaataaaatactggcaaactgaatccagcagcacatcagaaagcttatccaccatgatcaagtgggcctcatccctgggatgcaaggctggttcaacatatgcaaaacagtaaatgtaattccatcacataaacagaaccagtgacaaaaaccgcatggttatctcaatagatgtagaaaaggccttcgacaaaattcaacagcccttcatgctaaatgctctcaataaactaggtattgatggaacacagtctcaaaataataagagctatttatgacaaacccacagccagtatcatactgaatgggcaaaaactggaaacattccctttgataaccagcacgagacaaggatgtcctctcaccactcgtattcaacatagtatttgaagttctgcccagggcaatcaggcaacagaaagaaataaatggtattcaaataggaaaagaggaagtcaaattgtccctgtttgcagatgacatgattgtatatttagaaaaccccatcatctcagcccaaaatctccttaagctgatgagcaacttcagcaaagtctcaggatacaaaatcagtgtgcagaaatcacaagcattcctatacaccaataacagacaaacagagaaccaaatcatgagtgaactcccattcacaatagcttcaaagagaataaaattcctgggaatccagcttacaagggatgtgaaggacctcttcaagaactacaaaccactgctcaatgaaataagagaggacacaaatgggaaaatattccatgcccatggataggaagaataaatattgtgaaaatggccatactgaccaaagtaatttatagattcaatgctatccccatcaagctaccactgactttcttcacaaaattggaaaaaactactttaaacttcatatggaaccaaaaaagagcccacattgccaagccaatcctaagcaaaaagaacaaagcaggaggcatcatgctacctgacttcaaactatactacaaggctacagtaacaaaaacagcatgatactggtaccaaaacagatatataaaccaatggaacagaacagaggcctcagaaataacaccacacatctacaaccatctgatctttgacaaacctgacaaaaacaagcaatgggaaaaggattccctatttaataaatggtgttgggaaaactggctagccatatgcagaaaactgaaactggatcccttccttacaccttatacaaaaattaactcaagacagattaaagacttaaacgtaagacctaaaacataaaaatcctagaagaaaacctaggcagtaccattcaagacataggcatgggcaaagacttcatgtctaaaacaccaaaagcaatggcaacaaaagccaaaattgacaaatgggatctaattaaactaaagagtttctacacagcaaaagaaactatgagagtgaacaggcaacctacagaatgggagaaaatttttgcaatctatccatctgacagggctaatatccaaaatctacaaagaacttaaacaaattaagaaaaaagcaacctcatcaaaaagcgggtgaaggatatgaacagacacttctcaaaagaagacatttatgcagccaacaaacatatgaaaaaaagctcatcatcactggtcattagagaaatgcaaatcaaaatcacaatgagataccatctcacaccagttagaatggcaatcattaaaaagtcaggaaacaacagatgctggagagggtgtggagaataggaatgcttttacactgtttgtgggagtataagttagttcaaccattgtggaagacagtatgacaattcctcaaggatctagaactagaaataccgtttgacccagcaattccattactgagtatgtacccaaagggttataaatcattctgaaagacacatgcacacatacgtttattgcggcactattcacaatagcaaagacttggaaccaacccaaatgtccatcagtgatagactggataaagaaaatgtggcacatatatgccatggaatactatgcagccataaaaaaggatgagttcacgtcctttgcagggacatggatgaagctggaaaccatcattctcagcaaactaacacagggagagggaccttaacatatccaggcctgtccggggggggtgggggctaggggagtgatagcattaggagaaacacctaatgtggatgacgggtttgatgggtgcaacaaaccaccatggcatgtgtatacctatgtagcaaaactgcacattctgtacatgtaccccagaacttaaagtataattttttaaaaaaaagcctctggtcgggtgcagtgggtcacacctgtaatctcagcactttgggaggccaaggcagacagatcacttgaggtcaggagctcgagaccagcctgaacaacatggtgaaacctcatctctactaaaaacacaaaaattagccgggcagggtggtgtgcgcctgtagtcccagctattaaggaggccgaggcaggagaatcacttgagcttgggaggcggaggttgcagtgagccgataccgtgccactgcactccagcctgagagacagagtgagactcttgtctcaaaaaaaaaagtgcttctgcacaatagaagaaattattaacagggtaaacagacaacctgcagaatgggagaaaatattctcaaactgtgcatttcacagaggtctaatattcagcatctataaggaacttaaaaaaatcaacaagggaaaaacagccccattaaaaaatgcccataggacatgaacagacacttctcaaaagtgagacatacaagcaggcaacaagcatatgaaaaaatgttcaacatcactaatcattagagaaatgcaaatcaaaaccacaatgagatactatctcacaccagtcagaagggctattcttaaaaagttaaaaaaaaatcacagatgttggcagggttccagagaaaagggaatgcacatacactgctggtggatgggaatgtaaattagttcagccacactgtggggagcagtttggatatttttcaaggaacttagaactacattcaacccagcaatcccactgctgggtatatatacccaaaggaaaataaatgattctaccaaaaagacacatgcacttatacgtccatcatattcacaatagcaaagacatggaatcaacctagatgcctatcagtggtggactgaataaagaaaacatggtacctatacaccatggaatactatgcagtcattaaaagaaaaggaatgaaatcatgtcctttgcagcaacatggatgcagctggaggccattttcctaagcaaattaaagcaggaacagaaaaccaaataccttatgttctcacttataggtgggagctaaacattgaatacacatgcacacaaagaagggaacagtagacaccagggcctgcttgagggtagaggataggaggagggtgatagtcaaaaagctacctatcaagtactgtgctactacctgggtggtgaaatcatgtgtacaccacaacccagcaacatgcaatttacccatgtaacaaacctgcataggtaccccttgaatctaaaataaaagttgaaaaagaaaaaagaacttcatagggaacaaaaacaatttctaagagatgaaagctttaataactaactgaattgtaactaatattctcggaaagagaagagattatattaataaattttgaatggtttttttaatgaaaagtcagggaatgagagcttctgaaaattaaaaatatattagtaaaaatggaaactcagcagaagatttggaagatgaaattgagaatattttcactaaactgtaattccaaatctcaacatgctaggttttcacttgattatctaacagaagtctagctgatttttttcccaatgttcccttccaatgcaatacctgagaattctcaaaacataaaattctgaaggtttaaaaatatattttaagataacctttaagcaaaaaaggaaatcttttgcttaaaaaatcaaaaaaatacaaattacgatctttttagaaccagacaatgaaagtattctatttattacaacctgtgggatatggacaggaagaaatttgtagcctgtatactgaaataaatgaattaggcaatccattcaagatgcatgaaaaaggatgacatagctgggcacggtgactcacacctgtaaccccaacactctgggaagctgaggcggaaggatcacttgagcccagaagtttaacgttatggtgaactatgatcacaccactgcactccatcctgggtgacaaagtgagcctcagacttgaaaagaaacaggatgacaaaataaagtacaactctccctccatatatgtgaaggattgattccaggactgcctgtgtgtacccaaatttgcatatagtcaagtcccacagtcagccttgcaaaaacccacatatatgaaagtttaccctcctgcagttaaatatatatgagttttgcatcccttgaatactgtatttttacctgcattttgttggaaatccatgtataagaagacccatgaagttcagaccgatattattcaagggtcaactgtatatattaggaagaaatcaaacacttctacgtaaacaacaacaaaaaaatctatttatacatacacacagagagcatactatgtaacaagcactgttctacatattttaattcattgtgctcacagagccctatgtgttggatactgttatgttacagttaacgaaaactgaaccacagaagattatgtaaattgtcaaatctctcaatgtataaaagaatacatcagaagtaaatgggtgttatcccaggactggaacattagtttatccttacaaaatctgtcattagcgattaaaggagacaaaattataaaaatttaaattgattctttgaaggcatctcataaaatttaatatattttgtagtttgggggaaaaaatcttaaaactaagcaaactaagataagtaactctttaatggataaagggttttagttccatatcccagaaataaccagttaaaaatgaccagttgctgtgttaatttattaatttaatataatttatcccccaaaatacgttgtggaacttagtaagctagttttaaagttcccatggcataataaggacacagaatagcaatgagttatgaaaagaaacaaaggtatggtggggtacaggagagatggactatataaaaccatagtaataattaaagcaagtatattattcacgtcaaaacagaaaaattatgcatagcaatgggtagcatatgataaagatagcatgttaaatgtgtcaggaaaaggctagtcagtaaaatgttggttctccatggtggggcaaaataaatgcatattaaactaatgtctgcatgaaaataaagactttaaaagcataaaagtaatggaagaaatgtataaggaaattatttatagatttgagtaaattttaaaagtaacccaaaaaagtgacaaaattctgcatcacaatcaaagggcaaactgggttgcatcatatgaccaatattttgttttataaatagggttcttcaaaatcaatagtaagaacataaatattgtccagttcaaaagacagacattttacccaggaaacaaacataaatattcctgcttcactagtgttaaaatgcagtagccagatgtgatcattttaaatgtatgtgtatcaaacaacacagccacaaaatacattaaataaaaatttccagacttgaaaggagaaatagataagtcaacaattacagttggagatttcaacacttctcattcagtaattgatagaacgattgcagacactcaaggatacagaagacttaatagtcaacacatttgatttaatcattattagggcacactccacaaaacaacaaaaatatatatacactgtttcatccaggtgtacacagaacttttccagaccacatctttggcagataaaataagacttgataaattcaaatgattacaataatataaatatgttgtttgattaaaaattgaattaaattagaaaacagatctgggaacaccaaaatatttggaaattaaatgacacactcttaagatgcataggtcaaagaaaaaaccacagggaaattcaaaattatctttaaatgaatgaaaagaacatgtgaaaatatatgggatggactgggcacagtggctcatgccagtaatctgagcactctgggaggacaagttgggaagattgcgtggggccaggagttcaagatcagactgggcagcacagcgagaccccacttctacagaattagccgggcatggggatggcatacacctatagttctagctgcctgagaggctgaagcaagaggattgcttgaacccagaagtttgaggttacagtgagctacgatccacaccactgcactccagcccaagtgacaaactgagaccttgtctcaaaaaagaaagaaaacatatgggatgttttctaagcaccctaaagcagtgcttagagggacagttatcacttagaaaggtctaatatcaacaatataagcttccaccttcagctagaaaaaaaagagcaaacaagaccaaaaatagaaaaaaggatataataaaatcagaatagaaatcaatgaaatagaaaacaggaaaaaatataaaattataattaattaaaccaaaacctggttccttagaaagatttttttaaaagataaaggttcagctaaaccaacaaaaaaagagaaaaggtataaattaacagtatcaggaatggaagaggaaacatcacagtaggtactacagaagttaaaagaattatacgggaatattatgaacaactttatccaaatttcacaccttggatgaaatggggaaaaaatgctagaaaaactcaaattacaaaaactgactcaagaagaaattgaaaaatcagaataggcctatatcaaataaagatactgaatttgttattaaaagtcttccccataagaaaagtccaagtccaggccaggcatggtggctcacacctgtaatcccaacagtttgggaggccaaggtgggcagttcaccagaggtcgggagttcgagaccagcctgaccaacatggagaaaccttgtctgtactaaaaatacaaaattagctgggcatggtagcgcatgcctgtagtctcaactacttgggaggctgaggcaggagaattgcttgaactcaagaggcagaggttgtggtgagctgagatcgtgccattgcactccagcctgggcaacaagagtgaaactccatctcaaaaaataaaaaatttaaaaaaggagaagtccaagtccagatgacttcactgattaattctgtccaatatttaagggaaaaaaataccaatctttcacaagtacttccagaaaataatagtaggagggaatacttccaaaatcactctgtaaagccagtatcaccctaatatcaaagccagacaaagacatcttgtcttgtgtattgaatatcacaaagaattaaaactacaaatcaatattccagccacccgtggtggctcacgcctgtaatcctggcactttgggaggccaaggtgggaggatcgcttgagcccaggagtttgagaccagcctgggtaacatagtgagaccccatccctattaaaaaaagaaagaaaacaaagcaatgtcccctatgaacatcaatataaaacttcttataaaatattaacatatcaaatccaatgacataaaaaagattatataccataactaagtgcagtttattccagaaatgaaaggttggcttattcaaaaatcaatgtaatacaaccatattaatagaaaaaatgacaaaaagcacattatcattgacaaaacccaacatccattgacaataattctcacccaagtaaggatagaggggaagttgctaagcctgataaaggacatctgtagttaacatcacagttatggttaaaagaaaaaaaaggaggggcgttccaagatggccgaataggaacagctctggtctgcagctcccagcatgatcgatgcagaagatgggtgatttccgcatttccaactgaggtacttggttcatctcattgggactggttggacagtgggtgcagcccacagagggcaagcacctcacccaggaagcacaaggggttgggggatttccctttcctaaccaagggaagccgtgacagactacctggaaaaacgggacactcacacctaaatactgcgctttgctcaaggtcttagcaactggcagacaaggagattctctcccgtgcctggctcggcaggtcccatgcccatggagccttgctcactgctagcgcagcagtctgagattgaactgtgaggtggtagctgggctgggggagggttatccgccattcctgaggcttgagtaggtagacaaagcagccaggaagctcgaactgggcagagcccaccacagctcaacaatgcctactgcaactcaacaatgcctactgcctctagactccacctctatgggcagggcatacctgaacaaaagacagcagacaacttctgcagacttaaacgtccctgtctgacagctctgaagagagcagtagttctcccagcacagcatttgagctctaagaatggacagactgcctcctcaagtgagtccctgacccctgtgtagcctaacggggagacacctcctagtaggggccgacagatacctcatataagcggctgcccctctagaacgaagcttccagaggaaggatcaggcagcaatatttgccaatctgtaatatttgctgttctgcagcctccgctggtgataccccggcaaacagagtctggagtggacctccagcaaattccaacagacctgcagctgagggacctgactgttagaaggaaaactaacaaacagaaaggaatagcatcaacatcaacaaaaaggtcatctacaccaaaaccccatctgtaggtcaccaacatcaaagaccaaaggtagataaaaccacaaagatggggagaaaccagatcagaaaagctgaaaattctacaaatcagagcacctcttctcctccaaaggatcacagcttctcgccagcaacggaacaaagctggacagagaatgactttgacgagttgacagaagtaggcttcagaagtttggtaataacaaacttcaccaagctaaaggaggatgttcgaacccattgcaaggaagctaaaaaccatggaaaaagatcagacgaatggctaactagaataaacagtgtagagaagaccttaaatgacctgatggagctgaaaaccatggcacaagaacttcctgacatacaagcttcaacagctgattcgatcaggtggaagaaagggtatcagtgattgaagatcaaactaatgaaatgaagtgagaagacaaggttagagaaaaaagagtaaaaagaaacaaacaaagcctccaagaaatatgggactatgcgaaaaaaccaaatcgacatctgattggtgtacctgaaactgatggggagaatggaaccaagttggaaaacactcttcaggatattatccaggagaatttccccaaccaagcaaggcaggccaacattcaaattcaggaaatacagagaacaccacaaagatactcctcaagaagagcaagcccaagacacataattgtcagattcaccaaggttgaaatgaaggagaaagtgctaagggcagccagagagaaaggtcgggttacccacaaagggaagcccatcagactaaaagcagatctcttggcagaaacactacaagccagaagagagtgggggccaatattcaacattcttaaagaaaagaattttcaacccagaatttcatatccagccaaactaagcttcataagtgaaggagaaagaaaatcctttacagccaagcaaatgctgagagattttgtcaccaccaggcctgccttataagagctcctgaaggaagcactaaacatggaaagaagcaaccggaacgacccactgcaaaaacatgccaaattttaaagaccatcgatgctatgaagaaactgtatcaattaacaggcaaaataaccagtgaacatcataatgacaggatcaaattcacacataacagtattaaccttaaatataaatgggctaaatgccccaattaaaagacacagactggcaaattggataaagagtcaagacccactggtgtgctgtattcaggagacccatctcatgtgcaaagacacacataggctcaaaataaagggatgaaggaagatctaccaagcaaatggaaagcaaaaaaaaaaaaaaggaggggttgcatcatagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagttctcagagacctacaaagagacttagactcccacacaataatagtgggacactttaacaccccactgtcaatattagacagatcaatgagacagaaagttaacaagaatatccaggacttgaactcagctctgcaacaagcgacctaatagacatctacagaactctccaccccaaatcaacagaatatacattcttctcagcaccacatcacacttattccaaaattgaccacatagttggaagtaaagcactcctcagcaaatgtaaaagaacagaaattataacaaactgtctctcagaccacagtgcaatcaaactagaactcaggattaagaaactcactcaaaaccgctcaactacatggaaactaaacaacctgctcctgaatgactactgggtacataacgaaatgaaggcagaaataaagatgttgtttgaaaccaatgagaacaaaggcacaacctaccagaatctctgggacacatttaaagcagtgtatggagggaaatttatagcgctaaatgcccacaagagaaagcaggaaagatctaaaatcgacaccctaacatcacaattaaaagaactagagaagcaagagcaaacaaattgaaaagctagcagaagccaagaaataactaagattagagcagaactgaaagagatagagacaaaaaaaaaaaccttcaaaaaatcaatgaatccaggaggtggttttttgaaaaaatcaacaaaattgatacacctctaccaagactaataagaaaggagagaagaatcaaatagatgcaataaaaaatgataaaggggatatcaccaccgatcccacagaaatacaaactaccatcagagaatactataaacacctctatgcaaataaactagaatatctagaagaaatggataaattcctggacagatacatcctcccaagactaaaccaggaagaagttgagtctctgaatagaccaataacaggctctgaaattgaggcaataattaatagcccaccaaccaaaaaaagtccaggaccagacagattcacagccaaattctaccagaggtacaaagaggagctggtaccattccttctgaaactactccaatcaatagaaaaagagggaatcctttctaactcattttatgaggccagcatcatcctgatgccaaagcctaccagagacacaacaaaaaatgagaatttccggccagtatccctgatgaacatcgatgcaaaaatcctcaaaatactggcaggccgaacccagcagtacatcaaaaagcttatccactatgatcaagtcagcttcatccctgggatgcaagcctggttcaacatacgcaaatcaataaatgtaatccatcacataaacagaaccaatgacaaaaaccacacgattatctcaatagatgcagaaaaggccttcaacaaaattcaacagcccttcatgctaaacactctcaataaactaggtattgatggaacataatctcaaaataataagagctctttatgacagacccacaaccagtatcatactgaatgggcaaaaactggaagcattccctttgaaaaccggcacgagacaaggatgccctctctaaccactcctattcaacatagtattggaagttctgtccagggcagtcaggcaagagaaagaaataaagggtattcagataggaaaagaggaagtcaaattgtccctgtttgcagatgccatgattgtatattgagaaaaccccatcgtctcagccaaaaatctccttaagctgataagcaacttcagcaaagtctcaggatacaaaatcaattgtgcaaaaatcacaggcattcctatctaccaataacaaacagccaaataatgagtgaactcccattcaccattgctataaagagaataaaatacctaggaatcccacttacaagggatgtgaaggacctcttcaaggagaactacaaatcactgctcaatgaaataaaagagaacacaaacaaatggaagaatattccatgctcatggataggaagaatcaatatcatgaaaatggccatactgcccaaagtaatttatagatgcagtgccatccccttcaagctaccaatgactttcttcacaaaattggaaaaaactactttaaaattcatatggaaccaaaaaagagcctgcattgccaagacaatcctaagcaaaaagaacaaagcaggaggcatcatgctacctgacttcaaactatactacaaggcttcagtaacaaaaacagcatgatactggtaccaaaacagatgtatagaccaatgaaacaacagagtcctcagaaataacaccacacatctacaaccatctgatctttgacaaacctgacaaaaacaagaaatggggaaaggattccctatttaataaatggtgctgggaaaattggctagccatatgcagaaagctgaaactggatcccttccttacaccttatacaaaagttaattcaagatggattaaagacttaattaagttagacctaaaaccataaaaaccctagaagaaaacctaggcaataccattcaggacataggcatgggcaaggacttcatgattaaaacaccaaaagcaatggcaacaaaagccaaaattgacaaatgggatctaattaaactaaagagcttctgcacagcaaaagaaactaccatcaccatcagagtgaacaggcaacctacagaatgggagaaaatttttgcaatctacccacctgacaaagggctaatatccaaaatctacaaagaactcaaacaaatttacaagaaaaaaacaaccccatcaaaaagtaggcaaaggatatgaacagacacttctcaaaagaagacacctatgcagccaacagacacatgaaaaaatgctcatcatcactggtcatcagagaaatgcaaatcaaaaccacaatgagatatcatctcatgccagttagaatggcaatcattaaaacgtcaggaaacaacagatgctggagaggatgtggagaaataggaatgcttttacactgttggtgggagtgtaaattagttgaaccattgtggaagacggtgtggcgattcctcaacgatctagaactagaattaccatttgacccaacaatcccattactgggtatatacccaaaggattatacatcatgctgcttagacacatacacacatataaacatattgtggcactatttgcaatagcaaagacttggaaccaacccaaatgtccatcagtgatagactggattaagaaaatgtggtacatatacaccatggaatactatgcagccataaaaaaggatgagttcatgtcctttgcagggacatggatgaagccgaaaaccatcattctcagcaaactgccacaaggacagaaaaccaaacaccgcatgttctcactcataggtgggaattgaacaatgagaacatatggacacagggcggggaacatcacacaccagggcctgtcagggggtggggggggctgggggagggatagcattgggagagatacctaatgtaaatgatgagttgatggctgcagcaaaccaccatggcacatgtatacctatgtatcaaatctgcacgttgtgcacatgtaccctagaactttaagtataataaaaaaaaaacgaatgcctttttcctgagatcaagaaccaggcaaggatgtttctattcctcactgtttctactcaacaattgtaactggggggtcctagccagggcagtaaggcaagaaaaaaactttttaaaggcattcagattggaaaggaagatgtaaaactgtatattcacagatgatgtgacctacaaattgaaaactaaggaatctacataaaagataccagtgctattaagtgaattagcacaatctcagaatacaagctcaatacacaaaaatcagtagtacagtatttctatatactagcaatgagcccctccagtgatgaaattgaaataaaaagaataattctattcacagtcatatcaaaaagaatatgaaaaataggaataaatataataaaataataatacttgtacaatgaaactaaaaaaacaatgctgagagaaattaaagaagacctaaataactggaaagattagaaggctcagcgttgttaaaatgtcaattatccccaaatcgatgtacggatttaacataatccctatcaaaatcccggcagacttttggtgtagaaattagtaaactaatcctaaaacttgtatagaaaatgaaaaatatctagaatagccaaaacacttttttaaaagaacaaagttgaaggactagattacctgatttcaaaatgtactgtaaaccaatcatcaagacattgtagcactggtatatatatacacagagatcagtgtaacactccaactaattttcaaccaaaagagaaaagatagtcttttcaaaaatgatgctaaaataattggatatccatgtgccaaaaagaaccccaatccatatcttgtgctaaatataaaaataattaaaaaggaatcatagaactaactgtaagggctaaaactacaaagcttctggaataaaacaaaggaaaatctttgtgaccttgggttgggcaagagtaatttttaaaaattgatacattggacttccttcaaaattaaaaacgattgctcttcagaagacaccattaagaaaatgaaaaaacagaccaggagaaaatatttccaaaacattctgataaagaactcatatccagaatatgtaaagaactctaaataacaaaaagactaatatctcaattttttaaatagaacatgtgaatacacactaaaaaggaggtacaaacagtaaataagtgtatgaaaagatgttctgtattattagacattaggaaattgcaaattaaaacctcagtgagatatactacacagccacttgaacaactaaaatcaccagttggcagtaatgtggagaaaccaaaactctcatacattgggctggtaaggatgtaaaactatacagcttctttagaaaagtttggcagtttcttaaaaagttaaacatacatttggcttatgaatcaataatctcactcctagaaatctacctaagagaaaagctcacccagtgttcataacagcattattcctagtagctcaaaactggaaataatccacatgtccatcaaactggtgaactgataaagcaaaatacatcttttcatgagagactttcaagcaaggacaaaaataaatatgtatatatatatatttttaaatatatgtattttttataacattccaccatatgatggtgagctgagattgtgccattgcactccagcctggggaacaagagtgaaactccatctcaaaaaaaaaaaaaaaaaagaaatttactaaaatgcactgaacacttaaaattggtaaaatctatggtatgtaaattaacctaaataaagctgtttttaaaaaagcaagagccaaaaaacttcagcttattaaattggcagcaatttttaaaacataagttttaaggataatattcaataaatgtttgcattactactgtatattaagcattattggatactggcaaatgcaagacaggatgggaagacagacagatgcagttaaaatatagtgtcttcactgctgtctcatagaagaaacaaattgcagaaacacctcactctaggcttactgcaggaagacacgcactttcaaacattgctggtaaaagcatattgccccagtgtccctggaaagtaatttgacaatatgtagcaacaacttgaatttatgccctttgactccctgatagtaattctgagtatctattgtaaataatcagaaatttggatagaattgtgtaatctaaacaattggcactggtcacaggtaattctaaaataaattcaaagcaacacaaatgttcaatatagaatggttaaataagtcatggtatctgtgtcataacatgcagctattgaaatgtacttgaaaatttttaatttcatagaaaaatccagattacaaaattgtgatataatctcagtacttaaaatgtgtgtatgtatatacacaagctaaaagataacaccccaaaatattaacagtcattaactctgggctgtggaattgcaagtaatttggttttttatactgttctataatttataaaggttcatgtaatgagcgtgtactgtattactttaacaaatgggaaaaaattatttttctcctttatctgtttatataggtaatacatgttcattgcagaagagttagaatataaacaaaaatctacacctaaaattcaccacccaaagacaggctgttttatcactttggagtatacccttctatacatttctgtgcaactagatcatgtattttacaaaaaatattactattgttttataacctgctttaaaggaagaagaaatagatagcagatctaaacaaatagacatgttcatctgaaaagagaaactagtggcatctaaagagaataaataattggctcaagcgaaagtttttttcaagttgtggtagcactgagagaacgtgccagtggaaggaagaaagaggaggcagggggttgcagacagaagcacaggtgaggaggggtcacaagaggagacgcagagaccagctggagtgaaattcaaccgttgtatatgagaggctcttgctgcttgctggataccccacttctgttgtgggagataagataaggcctacacagaacacatgtgggttatgaggtcccaaggggcaaggaggcttacaacagccacagtctatagagcaagcactagaatgtgaacaaaggaaaggaaaggaaaaagcccgtttacaggaataacaactgaccaactcgtgcaaaagcaaggccagacctaaattcccaaggctaaatcaactagggtttcatctcaagaaagaatcacagatatgtcagggagagtctaattgtcaaacagaaattgccagactcaggtatcagaaagggaggaatgttagtaccacagaaagaccagaggcttaggagccagacagatctggtccactcaccagctgggcaggttacttgactcctgaggctcagtttcagaaggcatcagcatccacttcctgaggtggttgtgagaatctaagatattatatgtaaacacctggcacatggctcatgataaatagtagctattactactccatataggagaaatacaatgtaacatcatgggcccactgcagtggctcacgcctgtaatctcaacactttgggaggccgaggcaggcagatgaggccaggagttcgagacctgcctggccaacatggcaaaaccccatctctactaaaagttagctgggcgtggtgatgtgtgcctataatcccagctacttgggaggctggggcgggaggatcatttgaatgaacctaggaaggaggtggaggttgcagtgagctgtgatcatgccattgcactccagcctgggcaacagagcaagactccgtctcaaaaaaaaaaaaaaaaaaaaaaaaaaaattatatatatatatatatataaaaaacatcatggttaagagcatgaaatttgaagttagacgaacctaacttcaaatccttgctttatcacacaagctgtgtaatctcaggcatccaagcctcagcatcctctataaaaataagggtacgacttggcacactgagctgttttaaggattaaataagacagtgtatataatataaggcccttaggcatagtgtctgtgtaatcaataaacaatggctatttattgctaccacttttgtgatcacattacctaacctctctgaagtagagtttattcagctgtaacattagcattctatcccttatcttgttcccttcactcctagggcacattttactgcttgacacagtaaatatctgttgcatgaacagcaggattgtactgagaattaagagataatgtatataatgaatctaacagtgtctggtatattaatgctaaaaaaaaatggagctatttgttttaccattagattgtgagctcctcaggggccaagaacgttttcttagtcttgtagtcccagcacctggcaaactgttacgtaggaggtcctcagcaaatgtttactgaaaggcacagaccacagcaatacagcagccaccctcactacaaggatatctacagtagtccagatgatttggccctccaaaaacaacttaaaatcctccacctactttaccatctaacaacaatcacaggtagccattgtgctaagcatctgtacctcctgatttcaagactggtacttatgtaatgtcttcagtaagtaacctcgtaatcactgcaggtctcagtgaggtgaagcaagaccaaagcttccgtaagtatgaggctgtaaacattgcaaattaacatgtctagcacacaaagtgatcacagcatacaacagcatttatataaactcaaccctcgtaagagaagccagaaagacagggtaccagttacttaatccaagtcaactaaatgtgttacctatatgaagataacaggttatgataccatatttataattaacattcttatggtttatgcaatggagtacattaaaaacaccacagaaattatgtaaagaaggctaaagggtcttccatgttactatcctaagaaactgagaccctcaataatcagaaacaagcttttctgccaatttgactaatacttgaaaaaatggaaaatataaagagattaaaatcactcttggttcaatgatccagggataaccattattttatacttggtatatttctttttaacacttgttactaatgtgttcaaaaacaggaattttagtgcttcagtgttctcaagcagtaactcacatccatttccctattattggacatttgggcagattagaactgttttctattgaatgtttttaaaggcagctttttcctttatattaaaaatatatgaattactctgtcagagatttttttttttttttttttttttttgagatggaggctcgctctgtcgcctaggctggagtgcagtagcgcgatctccgctcactgcaagctccgcctcccaggttcaggccattctcctggctcagcctaccgagtagctgggactacaggcgcctgcaagcacacccggctaattttttgtatttttagtagagacggggtttcaccgtgttagccaggacgatctcgatctcctgacctcgtgatccgcccacctgggcctcccaaagtgctgggattacaggcgtgagccaccgcgcccggcctctgtcagagatctacatttacatccatcagcactggaaactaaggcactataggtaaagaaagccagccagaaacccattagagcaatcgtccaggaatgtaactagtgagaagtatgaagcccaactctcctcagtgaggtgggagaatgtaggagaggaacagggaaacagggagaatggaggcttgtgtgtatatattagggtatagggaaagaaaaagaaggaatgacatgaattaatattctaaaacatgagttataatattacagatatatgagtttagaattattttttaatgcttaataaacagagcctctacgtgggcctgaagttaatgttttatttttttccacattgaacgaaccatatcaaagcccaattttaatttatttcaacagatatttactggtacctactctatgccaggcactgtgcttggtaataaacatgaattcagaccgcgtccttccagttcataattagaatatatttagcccacatttttatgctgtctacatccacaatgagtaagaattaacagttgatagctcatgattctgaagaactgcaagagttcctttaaccatcaaaactgaagtgaaatctacttcctgggacaggaaagcaagtggtacatattaggaaacttcaacaagagttgaaactaaagattttctggtcactggatgggttaaggaaattcagtgaaccaaatatccaacttccaaaatttcagctaatccattttatataagtggcttaggatatctatttttaacttaaaagtataaagataaatcacacacttgtatttctgaagcattatagactccaaactagagaaatattgaatttttttttttttttttttttttttttttttttttgagacagtttcgctcttgtcatccaggctggagtgcagtggcacaatctcagctcacagcaacctccacctcccaggttcaagcgattctcctgcctcagcctcccgagtagctgggattacaggcatgcaccaccacgcccagctaattttgtatttttagtagagacagggtttctccatgttggtcaggctggtctcgaactcccaacctcaggtgatctgcccacattggcctcccccaaagtgctgggattacaggcatgagtcaccatgccaggccaaaatattgaacattttattctatgcctataggtaccatgtgtcttagatatgcccagataatccctgaatcaaatattctattcctttgtccctgtaaatagtcagaatcctggaaactggaatcaaaacataactcccagacaacaccctgaaactgcatacaatcctttgtcaaacaatttatgtcccagtcattatctctgctcattccaacttttatatttccatcccaggaatctgcagagcccgccttaatgcttttgcccagaaactgctcatctgaaagggaagacttacttagggaagtaagtttctaaaggcagtggtgttgctggccaaattacatgaaccaccatatcccctcatgctaacaaaactatgttagagaatttgttctcaggctaggtgcggtggttcacacctgtactcccagccctttgggaggccgaggggggggatcatgaggtcaggagatcgaggccatcctagccaacatggtgaaaccccatctctactaaaaatacaaaagttagctgggcatggtgttatgtgcctgtaatcccaactactcacgtggctgaggcaggagaatcgcttgaacctcggaggcagaggttgcagtgagccgagatcacgccactgccctccagcctggtgacagagcgagactccatctcaaaaaaaaaaaaaaaaaagagtttgttctcagctgggcatggtggctcaagcctgtaatcccaacatttttggaggccgaggcaggcggatcacctgaggttgggagttcaagactagcctggccaacatggtgaaaaccctatctctactaaaaataaaaaaaattagctaggtgtggtggtgcatgcctgtaatcccagctactcaggaggctgaggcaggagaatcgcttgaacccaggaggtggaggttgcagtgagctgagatagtgccactgcactccagtctgagcaacagagcgagactctgtctcaaaaaaaaaaaaaaaaaagaatatgttctcaatttgatacctatgatttctagtaaattgtttgtgaaccctgtgagttctgctttaatcctctgacccctctgttcattcaaaaatggccagttaacagaaaacacctaataaaataatcttcatttgagccccggggaataccactgaacccagaagtggccatgcagaaggagtcagttaacatactttgttctccacgttctcaagaattcctggagagcaggataaagattaaggttctaacagatctgactcaagatgaattgtgaggccaagctcagtagctgacacctataattcccagcactttgggaggccaaggcaggaggattccttgagcctaggagtttgaggctaagatcatgccactgtactccagcctgggtgacagagtgagactctttaaaaaaaaaaaaaaaaaaaaaacccgggctcagtggctcacgcctgtaataatgtcagcactttgggagaccgaggcgggcggatcacctgaggtcgggagtttgagaccagcctgaccaacatggagaaaccctgtctctactaaaaatacaaaattagccaggtgtggtggcacatgcctgtaatcgcagctacttgggaggctgaggcaggagaatcgcttgaaccccggaggcagagtttgcagtgagccgagatcgcgccactgcactccagcctgggcaacaagaacaaaactcagtctcaaaaaaaaaaaaaaagccggttgtggtggcacacgcctataatcccagctactcaggaggctgaggcaggataattgcttgaacctgggaggcggagggtgcagtgagccgagatcacgccgttgccctcctgggcgacagagcgagactctgtctcaaaaataaatgaatgaatgaatgatcatgaatgaattctgcactcttaccattttactgactccaatcctgtcccggcaactctacacattgtttcacaagagcattaggacatcactttccattcagcaattcattttgagcacctagtgccaatcactgtactatagcccaaggaaattagtgagttacaaaacggacactttacaatcaagtgaggaacagatttaattatgtaaatatgaaggagacaaataaataagatgaaccagtaatggacaaggagttgcaacttatggtgctgagggaagaattttctgagtagttgataacacctaaaaggttgaaaagaaaaaacagcaaaaatgtcctaggcagggagtaaaatatgtgactgtgtgcagtgattttgaggcaggaaacagcatgttggggagatttttaaagcctagtatggccagaatatagtgagcaacagagggagatgtggttacaaagtctagcaggggccagatcatgcagggcctagggaagccactgaaaattgttaagcaagggagtgatataatccctaccccttaggttttctgaagattattctgccagattagtggaagtgcaagaacagaagtagggagacaaataaggaagccattacatacatctgaatcagagatgtggttaattaattcaggagtgaataatcagaaaacctgtacatgacatctcagattaaaagatgaacacaagctagccaaagagggaagggcatttcaggcaattgaaaaacatgtacagtggcattaggtcccaagaccataacctattccaacactataaacagcctggtatggcagtagcaaaggatatgtggcaagagtgtaatccaaacaagaaagtatggtaccctgaacttaagccagtggtggtagggaggaagaggcagggttgtatccatatggtcaactgtagtgaggtgaggaaagaggaacttgggataaccgagtttctggctttgagtgggcagatgacagtgccattgactaaaatagggagaaccagggcagtgggaaagatgagttcaagtttatacatgctgctgttctgaaagagccatctatatagtaggcagctggatatatggagttctccagcttagaaagaggctgaggctggacatagtttggaaaccacaggtgagtaggcagtgagtaaagccatgggaaagactaagcttaccagggaagtacaaaacgagaagagcttattagtccagaacctgggacgcactggcattgaaggagcaagagttctaagatgggtaattttattgtgagacatacggcacattgtaggatgtttagcaccatccctgcactctacccactagatgccagtaggacccactcagtggtgacagtcaagacacagacatgtctccagacatgcccaaatgtcccctggcggcgggggacaaaatcaccctagttgagaaccaccaaaattaagaggagtctccaggatgctgacaaaggagggttattgaatgaacttccttttgcaaatgttttattcaaaaatgacatacacaaaaatgtataatccctcccccaatataggattaggtgtcactcaccaacatgcccaaaatcacattaagtgatcaaacccagattggaacctgacttttatagtctgactccaaagcctgtgctctaagcctaaatcacttaacccctaactccataaggtctccattaggcttcaagtgctgtgaggagagggctgattcagtctttttcatcattataatcctagcatttggctctgacacttagcaacaggagttcaaatatttactgaatgagtcacacttcacacttaactctgaaaatatgcgttattcatagacctacactgaggtatttaacactgatagcttacagacaacacgttagggcaccaaggggaagatgctcccatcctgacaagaaatcagcagcattggttttgagaattttgttccccagaacagaggctctgccatcaaccatttcacttgcattagcggaaagttcctctcctattgcctccttatccagcacatcccatgccgcattgaggcctcaaggagatgggggaagaggagtggaaacaagaatggaatggaatatttttattaaatgaacaaattataacttttgacagtatcataaactggtagtcatagggaacaattttctatcaagtaagctttttaaaaggtttaaacctctaacctctattcaaaaatgttggcctaggctgggtgcagtggctcacacctttaatcccagcactttgggaggctgatgggggtggatcacctgaggtcaggagttgaagaccagcctggccaacatggcgaaaccctgttgctactaagaaaacacaaaaaccagccaggagtggtgatatacgtccgtaatccctgcttcttgggaggctgaggcaggagaattgcttgaacccagaaagcagaggttgcagtgaaccaagatcatgccactgcactccagcctgggcaacagagcaagactccatctcaaaaacaaaaagatgttgactgggcgcagtggctcatgcctgtaatcccagcattttgggaggccgagacaggtggatcacttgaggttaggagttcaagaccagtctggcaaacatggtgaaaccctgtctctactgaaaatacaaaaattacccgggcatggtggcacatgcctgtaaatcccagctactcgggaggctgaggcaggagaatcacttgaacttgggaggcagaggttgcaatgagccaagatggccccactgtactccagcctgggcgacacagcgagactccatctcaaaagaaaaaacacacacaatgttttaggaacttgaataggtgccacttactgtatatacctacctcagcatattttccctcactaattggccccaattggtacctttttgatgaagggactgtatgtccacaaattcctgcttaaatattgtgggagatccctgcaagggctaagccagtgatgtcaaatactataatagacattgctgatgtacatttttctgatgtacatatctacatatgaggctcagagatatagcctcagaatatttatcaatatttcaggcagccacatcatttccaagagaaaatatttcatctctgcctaaagccaaccttaggggtagcctggaggatacagaattcaggggataccagcaacacctaaaaggtttagcagaaggacatcttcccaggatgagtatccaggtccaggtatgctatagagacctaaaaagtagaatgatgggaaatccataaatgcactttagtcagttcaacctacatacttgaacatctttttgtgttgcttggaagccacggagggaagctataaagcaatctgagagttgagaaagtttgccactctggccgaccagtggctcaagcctgtaatcccagcactttgagaggccaaagtgggcagatcacctgaggtcaggagttccagaccagcctggccaacatggtgaaaccccatctctactaaaaatacaaaacttagccaggtgtggtggcgcatgcatgtagtcccagctactgaggaggctgaggcaggagaatcgcctgaacctgggaggcagaggttgcagtgagccaagatcgtgccacttcactccagactgggtgacagagcaaggctccgtctcaaaaaaaaaaaaggtttgccactctgagtggaaaccacttttaataaggtcaagtaatgctcatacttcatggacctcaaatttttctttacctagcaccatctgtaattctctcactcccaccaaccaccctagggaaagcttgatacggaacattttcaacaaattctgacatggacttaagctttaaggaacagggagaagaatgtgttttctgctctagagtgttgcctccttcacggcagttgagttgctcacggcctccatttagcaattcaaggtacctttgtgggctggtcttgaggctcggatttgccatattgatttctacccaaactttaatcaatcaatcagttaattcacttttgctttgttatttcagctttgaagattatgaaacagatgaacctgcctctccctctgaatttggaaacaaaagcaataaaatattaagtgcaagccttccagagaaatgtggaaagcttcaatcagtggatgaagaatagctgccggtgtctacaatgaaacgaagatgtgtattttaaatgtttctttcttgtgaagagatgttctcgtttgcatactgctttttaaagactttgatttctccaagtgtgtatcatctgcactaggaactttgtttttaagcaataggtctggatacacatttaacttaggaggctcctccaatttgcctcaaacctcttacggagcttctcctcagaagtggtaccatcgccttccaaagtcagcactctacactcttgaatgtaccaaggatctcttggcgacagtaccaagcacggttctctacacaggtgactgaagttgcctctgtgttggctggcatccctgagtcccctccgggctcctatggagcctagaagaaaccttcacttgcagaaaacttgagtcagaaaattctggaacttgaaaaagtagtaagggcctccagaattgacttagccctagtaataaaagcactgccaaaacatctcagagacttcttttatgtatactggagttcaaagatctttaacttacctggcttaatgtaatttcacagttacctgccaaactactagtcactttacatcctcaggtattgtaaccactgggccttccaactttgctggcaagctctggtaacctccctgactgtggatcttatataaaatctcaagataaaaaaacacttcttaaatgaagtatagaatttgactcatacttggaaaaagcccttttaacttttatcttttattcattgaactattgaatgatgtatttaatatccaaattagttgataactgttttcacttcctatcagaaggcctgcttgaagacataaaggaataatgatacattaaaattcttactagatagatatattccttcctcccaggagtattagactagctaatagtaaaggcctcaacgttattctttacttcatgttgaaaacaattactacagatatttcatccacctcagtatttatcaaggaaatggaaaatgatacagctataaaagaaagctgttatttactgtagttgtagatgtattcactacagaatcctacatttttcagcaggccacagtccagccaaatcctataatatccttgaaaagaaactattaaaaaggatagacatttctgatgtaagtaaaacccccaagcaacttaatatccatctgtcagtcatcaacttttcccctagattttttttttaactagttctgaaagtgtcaagaatagcttccctttccaccctacctaggttccctccttgctggcataaaggccaagcagtgaaatgaaccttgggttagagttatggtaggcaaaaagaaaaggagaatttaggaaataaatatgctataaacaaggtacagtacagtgagagttaacaatcctaggaatcctgcctgtcacaagctcccagttccctgtcattttatcttcatgattagaactgatcttccatttaactattacagaaagcagtaactattgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccagggaagaaaagcaattatttcatttcagatagaaatacaaaaaaaaaaaaaatacttttcttagaagccagatatggtttaaatgttttattatccataatgatctaaactaataagattcaccaaaaagtaaaaattcaattttacaatatacatttttttttttaactatttggctttacctttttaccttggttctccttactgaagtcctcttgctttcactttgatctggtttttgaagtctcttaattattggctgggcatggtgactcatgcctgtaatcccggcactttgggaggccaagggaggtgatcacttgagcccaggagtaaagaccagcctgggcaacatagtgagactccgtctctacaaaaaataaatttagctgggcatggtggtgcacatctgtagtcctaccaacttgggaggctgaggcaggagaatcgcttgagccccaggcttcgaggctgcagtgagctatgattacgacactgcactccagcctaggcgacagagcaagaccccattctcttacaaagtctctattataaaagtacatccatcaataccattccatttaaaatgggctattgtaatttacccacattatcacattttcaggaattataagaatgtgttttattgtactccttccttggagctgaatgcaaggaatgtgaattctgaggaattaaggtagaatatatttgactttctggtaaagatcatggttaagtataatcattactgccaaactggaattttcaagttattataatatcccaggccccttgataaaagctgagggttatcatgaccttaatgctaattcaatgagaaatgagtttaatagcataacattaccaaggtaatcaaactaataaaattccatatatcttccctgcatcttgtcactgtgtaccattcaaagtgtttataaaactctagattcatcaaatgagatttgctcagctttttgaaatgttaagatgtgtttggagaaggctgcatgactttgtttttcccttttagcaaaactaaataaagttgtcaaatat

SEQ ID NO: 37287 - DNA, 26740 bp, Homo sapiens
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtaggaaaggccctcgaaaagtccggggcgcattcggcacttgttttgtttggtgtgatttcgtaaacagataattcgtctctagcccaggctaggaggaggaggagataaccgccggtggaggcttccccattcgggttacaacgacttagacatgtggttctcgcagtaccattgaacctggacctcccttcacacagcccctcaatcgtgggaaactgaggcgaacagagcttctaaacccacctcagaagtcagtgagtcccgaatatcctgggtgggaatgactaagacacacacacacacacacacacacacacacacacacacacacacacagtaggaaaggtgtatttcaagcacactttctttctccttggggagaattattgctaaccatctaagttttctggaggcggccttttttctccccagcctcccggcggggtcaccctctcccaccttccaggagagtggaggacccgtgagatacggggcacgcaggcagcgacttcctgaaatgctaacaaggatcgtaggatcagttactgctgcgaggagcaagcacttgcttcttgggggagttttgcagccaacagggaaatgggctttctttgtgagttagaggtagaggtccggcggcctgagtgattgaaactgctcgggacaatgctcgtatgtttagcaaacgacagaactgtagaactgttcctgagaaatcccaactgatagtattttagtcatctcagacgacagttagcacagtttaaaaatgaggcctacttcttgaaaaacagaatccaaggtagttttgtcctcacattgacaaatgttgacacagccagtgtaatttcctataaccaggaaaactgaaagaatatatgtacagttaaaatatgtacaatgctaattaaaacttgtgtaataagtctaaaagtaatttaatgaggcttcacttttatgaccgtccttgtggtatgcttcgccaggaatatatagcttcaaaaagcaaaggccagcggaggggtaattatttttttactgcaatgttaattgtctctttgacatggaaatataaacctgttaaaactatcagtgtttaatttagtgtctcaatttctattagcaaaaatttataatctataggataaatgcacattttattttttacttttcatattatgcaagttaatttttttaatttagtcaaaggagcttataaaggatttcagggcctgttgctggatttgattttaattcattttgaaacattgacaagaccctggttgttgttttttttaacagtggtttatccgtatcagcaaaagtttagccactgtgaccggtaactgtatgaatatagttcttaatattattgtctatataaaaatatttattactctagttaatattattctatataaaatcattttgtttaaattattaagttgcctctgaaaatctgtagtaacaaagtagaacatgtcaatgtatataaatgccataattatgtattttttagtttaggcctataaaacataacattgtggtgattttaagttagagaaaatattttatagtatgttaatgtatatgcatgaaatgcaaaaatatttaaatgataggttcattgaaatagatcattttttgttatttaggtataaatcaattttcaggacgtatgtgaaaagcgcaatcttcaggaagtttctcaagatagaacacagcttggatagaatgtcttgaaatatatgcaattttccaatttcatatgtaaaatgatatacataatataaaatctagcggtgttaattataatgatatgtaattatatatttcacattaatatattttatgcccatggctatattgatttgggaatatatatggatactaattatgttaggattcatacaattccttgagaggcacaagtgctaaaaattacttgtatgaattatttaatatcattgcaaataagatgttattttaactttttttaagtttctgcaaatatgtttattatgactttttatttttatatgattggaaatacatatactaaaattccacgttaccagtttcttaaccacagaaacctgaaaaattgccatagttgatttgttacttctaccttggtgcatttacaaaatagtcatatttttattatgaagttaaatattcatttgtttatagctacttcagaaggctcaggttatttttttctttaatagcacagagtcctctcaaggtaagcactgtgcagttagtataaaccattattccccatgtgtacatgattcacagtttgtattgtgttccaagtgaaccatagccctttcagaaatcaagacttatattcattttacttctttgagtactcttgaattttagaaagtccattatgatcctaaggtagcaacaacatagcctattaccgtctatgatggtttacagatctattattccacgttagttcatcactatcaactaccatgatagagttaagctaaaccattttcccaacatatgaaaaactcctattactaaagtgatacaaatggtatcaaaaatacttttttatagcaaggttcaacagtgggcccagtgcttttacactttttcaaaagtccttggagaaacagagaaaatctcacttgccttctgtactaaaacattctaggccgaactaaaactgaaacttcatagtagaacactgtaggccaggggtgttcaatcttttaccttccctgggccacataggaagaagaagaattgtcttgggacacacattaaatacactaacactaacaatagctgatgagcttaaaaaaaaaaaaaaactcatgatactttaagaaagtgtatgaatttgtgttgggcagcattcaaaaccatcctgggctgcatgtgaccctcgggcccacaggttggacaagcttgccctagctcctccatctgctgcaaagcccagcctgatacaaaaaccaacgtgataaaaagtttttgtggtgctttattttggcagtttaagttatataaacaatgggtacagtttcattttctaaatataaaatttttacattgaatatgaatttttaagacaaattatctgaattctgattctcatatacctaactactaatatcttctctatttgttgcccaatgagattaatccacctcttaaacacttcaccatcaagaaaaacaattttgtattttaaaatgaacccatccactttcattcagctattttatattcaggcatcatcctaaggaaagaaaggttctgacaaagattaatacagatggataagtagtagcaagaaatcaaaaactgcataaaattctagcaataaagtgttaaattatggtacagttacattctggatcatcaggtatctgaagaatatttcatagactgttaaatgattgcattataaagtcaggtttttttaaagcaagattccaaacagtaaacagtttctctctctctctctctctctctctctctctctctctctcaccaaattagttataatggtttccgcaggatgagaggggttgggaaaaagtttggtgatatttattttcttcgtttcacttttgagttttccaaagtgctatgaccatcatcagtaaaatatacatttccaaagcctttgacacacggtaacagtcctacacagtggatgaactaagagcttctctacccttagatgggtagggagggaggaaagacaaggaaactgagttgtttaagtgtcatacacgagaacgtggctttaaggtctgggaaaacctgcgagggctgtgacgtcagactgtgaaatgcacgctatgtccattcaccaagacgttccattttaaaacccataaatccgtagctatacctgtttccaaggtgcctcgtgttaggcctctggtcacagcacttggcgcccttcttgggatctcttctctccgcccccactaccccaccccacaagcacactctagtcccctccaatcaatttcaggcaggtctcgccgcctccggagccacgctgggggtgcaagggccctggacccgaaagagcgcccgcccggcgacaagagatgagatgcacgctgctcctccactcctcagcccccaccatcctcctcctggatcctaacttccccactctctcaattcctagagacgctgcggatcccagaggcttaactggcagctggaacgaggtcctccaacaagaatttagacgctaggtccaattatcactccaccgcgcgcactttccgcaggagcgatgtgatccgttatcataactgcggacctggggttccacgtggaagacgattgggatttcactggccgcggtgggggtgggagcagacagagtctgagtggggttagtggactcgagacgaaaggcaggacatgacagaaggcaactctgggtcacctctccagcttggaactggctaggccttgttttggaggggatgggtagatgaaaagtgagtcagggttacccggaggaaccacggggaaagtgcgcttctgagactcttgacagccatttcgttcccttccaagccagatggagacccaagagtgttgaaaggccacgacttccctcagtttctccatctgggggtgcaggatggtatagagagtggcccgtagtatttttccagtgacgatgtctctccattgttttcttcttatattgcagctttccccatgtttgaaaattttcttttcaaatgaaatcattgattagaataaaaaaaagtaagtagctattaaaacaagatcaatttccatgacagtaagccaaccgatggagaaaaccttgggaattaataaatgaaggatttgtttggtagatgataaaaggtccttttaaagggtctgactcttcctagaaaaacccaccaacttgggaccgcaacagatttaccatatcctaattcatgctattttaatgtgtattcagcaaacccacatgtgtttacaattgtcgaagctaccaaatgtcaatagcgttttttttctatttgttgaatgtgaatctcttgtacgaagccatataaacagaagaaattacaggaatgattttaaatcacatacaaaaccaatagtattgctagaggagagttagtcaaggacggcattatgaagaaagtgagggagaatttccaaagagcagaacgatagggcttggtggaccaaagaacgtttccatctaaagggaatggcaaatacttagagtctctgaacccactgaatcttggactatttaactaatatttgtagttccagatatagcacagtgccttgtacatagtggtatttttaaaaatatagtgcctcgtagattttttttcaacttttatttaggaggagagggcacatgtgcaggttaattacaaaggtatattgcaccatgctgaggtttcgagtacgactgaatctgtcactcaagtagtgagcacagtacccacagtaggtagtatttcagccctcgctcattccctttctcctccatctagtagtccccaatgtctattgttctcatatttatgtccaattagcatttgttttttaaaaagggtggttgaagaaattctcagtgcttgtcagtgtctctcagtgcattcatttaattcatgagccctggaatgatggtttcatttgggcagaactctacaatcaaaaagaagtaataaaagggaaaaaaaagtgaaagccatcaactacaggattgaaattcccaaagcatcagaggtcctttcaaaaaatagtatgttgatttttaatttttatgacttattggctttgttcatgaaaatataaacatgttatcacaaaggattttttaattcaactatttctcagttttctctttcaccttcaaaataaaatatcataaattatttaaatggttgtgaaggcagtaggatttttttaagagagaaaagttttatagaggttcagaattacatgaacaaagacatgtaatctcttaagcaaattgaaactaataaaatcgtacaatcaaggtaacgtaaataaaaaagcctctgctttcttaattgaattatgtgagtaactagaaattttaaaagtatggcaaaggttaacaacagcattattacctgggctgcctttaaaaatacatatttctggggttcacgttcagaaaatttgattcagatttgctgtgggtcccagaaatctgcattttaaataaacacttgaaggagatactaatacaagtggcccattgggacacaatttgacaaatatgaccaattttactttttaaaccttatttctgcttctttatctttgaattgaggtccaggattttaggtaagattttaagtttagagtcagtttactggatcccagggaggagagtctgagtaatcagtggaggagttatttcaccaaatgaaggagaccctttattattatgtgaccctttgtatgaattggaaaagaatgtcttgtagataccacatttttacagtcagaacatagtttgagagaaaaaaatataacaagatatatttgtgttttaaagcttacagaaccagacagaaaatttccacataagctatataagatacgttgtctttttaaaacactatatacacttctttctgttcgtgcaggatgaatggatctctctctctctctctctctctctgtgtgtgtgtgtgtgtgtgtgtgtgtgtgtgtgtgttgtaataaggggtttctttcattttatgatccagaccaggctcgtaataaacatgacaacctaaaattatgtaaaaaagaaaaatcaaagcacaagtgtttcacaggtttaacttatgcttatctaagatcagggcaagattgcaggaaaatgtagccataacagaataaagcatttatggacaaaatgatgggtctttatgtctctgtaaaagcacagtgatggggggggaaatatagatgaaaaatgtaagctaaaaagtaacaattataagaaaaactaaaatatcatgcctttcaaatgatcatttttctgcttttaagctaaaatttgtctaatattacaccagtgactttgctgatgtattaggaaaaagcttgttttgctttcttttctcgagtgccaccattttcttgctctcattctctttcaggctgccagatcatctgactcagcaattgtataactctctcacccaatttaaagaaacagcagctgtctagagaacaatgactcccccagttgaacatctaattgttaaatgtccaacatcggacactttgaattttactccatgcaatttacatgctgaatagttgaagttgaatatattatatttaacatttaatttttaaaagcttattgaaactttcttcctaaatcacatggtaaagttattgttttcttcaaaaacaattaggaggagcttaacaataataggacacttcaacttccattatctaatttaattatcacaatatccttatgttttcaatgtttcattttttcattttgtagatctggagactgaggctcagataggttgcatggcctaccaaaagtcattgactagtaattcatatatagttgaacttggttgcccatggagtgctataaatatgtatatggtttcagttccatctcttttagttaactattattttgaaagtcgcttaacccctttgggcctctactatactcaagcatcagccgtataagtcacagtaaatatttattggttgaaaggaggttaacatctttcaaaaatttattttttgaccaaaataaaaccagtgaaaaattctcatatgactgtacatataaattacttattcctaccttaatttaaaagcaataagtgggatacctattcaccagcacaggaaccacttgaagcgtgcagttgaaagattactttctttagcattcacatgacctgtgagcagattctatttcttttgcttattagctgtcatggtaccagaatgaagtatgagaaactctcagtgctttcatgttctcatctgtaaacctgagaccctatggtagtcccgtaataagaggtagataaaatagtatgtgtgaagagtcactgtaaacttttacacagtgtacgtttgtcagttattatagtgcctaattaaactatgcccttaagaaagcacattagttttttacagtaaatacctacttcattataatttttcagtgtagctagaaatttctaaactccactttaaaaatatacatatcataataaaaatatatttatgtattcagactcctggtatgttccaaggtgttaggtaaaatcagtgtaaatttgcatacttttaaattcacatctgtacagaagatctatatggtggcctttagggtatacctctaagctattctagtattcataatcattaaagagatattaagcagtgtttgtgaacccctgttttctaagacaggaaatcaaggtagctttagaaaactggaaaaaaagttattagtctatctatctaataacccagaataataatttccaaaggaatcactgaagataactggatttttaattccttcagaatggttgtcacagtctgaatatctgaatcaacagttttgaccaaaacaattttctaaaaattctttagtataaaaaattatgtgtgtgtgtgtctgtgtgatgaaaggaatgataggcagaaacattactgtcatccttacgacattcaaaatgcctaccttggagggtgaccttcagttatttttatgcaaatgtgaagaagttatttagaagtaggatatcaaagagtaacacaaaatacactaaatagtatgctttcttaaggctaaattgacttgggggttttaaatcagtacagagtaaacatacagtatattctgttatcattgcctttttgaaaaattaattatggaagttatcatcttaaccgtaacaacacaaaagataaaactctaccctcaacccagagactcaaaggaaaacatgagtggaaatgttaaatctgtatgtgaaaagtgctaaaacatgaataggaagcagttacttatttaatcaaagttgattatatttcatcaagaagttgattcccttgagtggagttgaatcacatatcaggtgaagaatgtgatttggggaagaatggtctaacacaagaaaattttcttgcaatctttaataatatcagaggggagattggcttcagaactctcctaagttcaggaaaggacacagaaaattgaacataacagtaagactatagagtcccaagaaagcaagctacttttaaaggatagttttttagaggggcaaaagggggacaaccattctccatttgatgagaaaagcttccatgtagatggtgcccctgaaattagagtatcctaaaccagtgttaaacctatcagtgaaacatgaatattaaacctccactcccagtagtgaaaaccgaatacattattatttatctgtgactttcaacattatctcagaactctaacagcacatgcgtacatcagcagcataagcagaaatgagatattatatatgcttgtgttagcaattaaaaaggacagcatatttgagaggggaaaatctgtcctatcaagaatgaaaaagagggaggttaggaaaagtagtttagagaaagtaaattttgcaattcctcagttttaactgtagtttctccattgtaccttccacttgaaatgcactccaagcagtggaggtgggtagcaatgaatgcagaggaaacactgaacacagtgacactctccagtgtcacttctcatgatttaatgaggggttttttttggaaattcttctgtcataacatgggaaactttgttacaaagaagctgttttttcagagggttagaattcagaggtagcatcataccttttagaagagaatttgcttgttgaaaccacagatacctgctagaatgtacaggaattaatgaaaaattactcaaaaggacatttattttgatgacctaaatgaataacttcatagtaaatgtcatatatattctcaaaaaattaaaaagcaccatttattgagagcctaccgtgcacccggatttttatatatctgacattctttattcctcacagtaaccttatggggtaaattttattttccccactttgtgaggtgaggaaataaaggctcagaaagtttacataacttattcaagcccacagagctggtaaatgagaggtcagttctatctgagtttaaagactaggcttgtcccacttgcatatgtgtcatttccaaaattatgattaaggatatggttggcatttcccgccacccacattaagtccaattaagtagctgtggccatagaaagaatggagaatggagagaggaactgacttcaacagctacagcaaacatttattagctgagtaaccatagctacatagttcctcaatatgtaccactcctccattttgttatctataaatcaaaatggtggctttttaaaaagcagttttacaatatattcaagagccttctaccctttgaaaaactgcaatactatttttagtagcaattagaaacaccttaaatatctgacaacagggacatcattaagtaaattataactttttccagtgggatgtgttacagctgttaaaagtagcatttatgaagtgtttttggagaagtttggaaaatgctgtaataagttagaaaaagctcatttcaaaattgcataatattcacaatgtaaagattaagcaaagaaaaaggaagaagtatttcaaaatgttaataattattgctttgtgtggggtagtttttcattttctatgtgcagctaattccttaattatttttaaatatgtgagctttaatcaggaaagcaaatcattcaaaaatgaggggactgaattaagtgactttcaggggactttgcgtgtctttgagttccaaatttctatcactatgtattactactgaagaataatcatagaagcacagtagtttctgaaaatggagagtcagtaatcttggcccaggttttgcaacttgctctaaagcagagtcctcaaagaaaaggaagcattgatgagttgtccacaatgtactggataaattatcattaggaaaacatattgtagtagggagagtgaggacctctcaaacagaactgagaaccttaagtttgaacttttcttttccttattacttaagcactctgagcttttttttttgtctgcattatgaagaaagaataatactctctatcccatgggacagctgtggaattataaattacacatataaaactgcttgatgcttgtcacatagctgggggttgaaaaaatgatagccattattttcttggcaacttttaatgaattttttattatctctatttctttctgcctatctcctctaattatgtttattacttattttgttcctcaggatgaggtcaattctcaatatctgtgctgtacataatatacatatataccaaatatgtgcatatagtatgtacatacatacatactgtgctaatcttttagtgttctcagctgatcaaatagctacaaatagatataagtaattcgccacaagtaatttatcaacataaaaaaaatttacaaaaaagttaaggaataattgtctccatgagctgcaaagatccctcatttcacaagagtacaccctagagatattttaatagtaaatttctcacatagatttaaaatcacatttgttttgcacataatttagaaaagatacctgctatataataagtaatatacttttaagtttccttcaaaatattcttgggaagatgataataggtactgctaattctatacccagttaacattttggaaactaaggttgaaaattgtgacttaactataattatgcattaaatctacaacacatcaaagaattttgcattttgtactccttactaagatccagtttgagtaggaagataaattttacagtaattctgaatgagggaagttggcacagagtttctaaaagagtaccttccttatagcaaatactaaataattgtgctatattgaatttaattaaatagagaatagtaaaagggagaaagaaacatccaatgttttgaaacttctagagatctactcccagggacacattgttttttcttagcaaatctgtttggaggtctgctctactttctcagaggtctccctttcatgctgaagctatcttttttccttgtggaacataagtaattaaataccttgcaattatttacctaagaaagtgtttctttcccgtttaaaatgctcttaccacccacattggactcgattatcagaatttttatccggggcagcttcaggagcactttggcacttcggggctaaaccacaatctgtttttacatgtttgtgattatacccgttttgtagatcaagacattgaagctagtaaaaaaaaaaaaaagtcattttttcagggtaacaaagtaggtggtagaactaggacagggactctaatttccttacattattgcttttctaaattaaagggatgcatggaattattcctccattgcctttgccttcaaataattatctattgcacccaacatcctattctagaactcatctatgaaggcttaacacagctgtacctgggagctccattacagggcatatatctcgctctcataagctacttcctaaggaattctctttaattatgggagcttttccagactctgaaatctttttttcctggtaacacaagtgtgaggtgtcatttatcagaatgcatcaccccagtcttccctcctcaaatgattactgtaggctccactcaagagctcatcccagttcaagaccaccttcctcctccagagaagcaaatatatatatacacgtatatatatatatacacgtatatatatatatacacgtatatatatatatacacgtatatatatatatacacgtatatatatatatacacgtatatatatacacgtatatatatatatacacgtatatatatatacacgtatatatatatatacacgtatatatatatacacgtatatatatatatacacgtatatatatatacgtgtatatatatatatacattttttttttttgagacggagtctcgctctgttgcccaggctggagtgcagtggcgcgatctcggctcactgcaagctccgccccccgggttcacgccattctccttcctcagcctccggagtagctgggactacaggtgcccgccacctcgcctggctaattttttgtatctttagtagagatggggtttcaccgtgttacctaggatggtctagatctcctgacctcgtgatccgcccgcctcggcctcccaaagtgctgggattacaggcgtgagccaccgcgcctggcagagaagcaaatatattgatggttgttaccaatacatgctcttgactaagaaaccttctttcttaattaatattgacaactttaagccgagtgcctgacatatattaggtactcagttactctttttcaactaaagttatgaatgatgattctaataaaagtaacttatttgtctactagttttattatgtttatttaattcattagaaaggccatggacatagtacaaaattcaaacaatataaatcatggaatgtgaaaagtaagtcacatgcccatcccagttcttcatttccttacctcacaggtaacagcttttcctgtatctccccagagatattctatgtatattttgtttttaacaccaagctatatttaaaacaattatctttaataataatgttaatattgaaactggtaaagaaatatgtgtgtattatctcacctcaagcgtaaacaatagaacaagagagagcccattttgaaaattatggacaatgaatctagaaataatctcaaaagattttgcagtcaaaaaatagttcattagatacatgagaactgtcacttggtctcagtgtagagctattgcctcaactccctttattttcctaacaaaatcatcttgcttatcccatgaaatacgtgcatattgccaatcctacaatgccgcatcagaaccagaacccaactctggaacactaccttctcaagtatctttctgtctctttatggtaatatgttgaattaatattcacatctattatgactagtctttgatttgtagggttgctgaagtagtagcaccactgcagggctttctttagtttaaagaaagtaatcaggtgtccctactgtgtcatgatctccaccctcagctgggttctccagtctggttttaaagaacaaaacaaaaggcttctctgtctgagtcttactcaacccatcctctctactcataagaggtattccaaacctttacgattctcaaacttcctaaccgaccatcttattttcactctgcaaacaagctaacctcctcattcatagaaggaagtgcctcaacttcctccccgttctgaccttttctccctcccaaatctatgtatctcttgtgacaaaatctataaccaccgctgtactttgagttctatttcttcattatttttgagggacctcaagtcctcaaaaatatcctatcttgcctgtgtacttaacttttcttttattcttttctaactttcccttctcttcacttggcacttgcccttccaggtatatgtgtgctcaggtctcctccaccttccatctgcctcacttcatggcatagggccttgaactatcacaaccaagctatgaaagagtagtcaacgcagtgtccccacttccttgccatcccattatcctagtttttcttttggctctctgaggagtccttcacaggctggttttcaggaataagtctaaatgaatcactttcagttttcctaaacttctatgcctttgcacatcctcttacctctgcctagaatatctttctccttcttttccatctttaaactctcacatcattcttcaagactgggatcagctctcagcatccggaagcctttgcctactagagacaaatgagaatgagtttggtcaccttttcattttcttgtatcattctgtgctttattttgctcttctaagagcgttacatgcttcatttaatccctaaacaactgtttgaggcaagtacagttattatcctaatcatgcaaatgagaaaacagaggcccagacatgttgagtaactttgataaaagttaaagaaccaataagtggaacagttgaggtttgaaccctggcagtctgactgtagagatactatgtttgacctactcccctctgcccccaccccatgtctgcccttagtttctgagcttgttgaatgaatgaacaggtggtagtctttttttgttataagactgatcagaattaagacaggtttaaatttcacgtgtagaattttcaaaactgcaaaggcagtgcaaatctaaaaaaagaatggcattctcaggaaagaggaaaagtaagtgtgagaataataataacaataaccaacaaactttagtaaatttagtaaatgtagtaaatttttacattaaaagcttttggacatacattatcatattttatggccacatgaaatatattataatcccattttgcacataggaaatctgagactggcataaggagcacagagatccaggactttatattttcattcttctaggattttgcacctcaggtcgatatgtatgagtaaactgggagtataatgggctctttaacagaaaaactaggaaagttttcccactattattaattatttacataatatttttttaattttattattatttatactttaagttttagagtacatgtgcacaatgtgcaggtttgttacatatgtatacatgtgccatgttggtgtgctgcacccatcaactcatcatttagcattaggtatatctcctaatgctatccctcccccctcccccctacataagatttataatggataatggacttcaatttctagagcaaaatggccccacccaaggatgccataatccttccagagctctactgcaagatatgagatatacatatctaaaacttgttcttggtatttccaaagcagtcaacttttacacctgtttataatgcatccaaatgttgtttttatatggttgcatctcccatcttcttcaccaatagctatatatatttttcacaagagctgaaagagttcttgatgtaggaatccatggtagagtttcagagaaatccctgaattcactgaaagttttatctagaaatacatgtgcaagtgaacacatcttttttaaaaaaaatcattacctactttcttttttgagaagaaggtatttatttcaacagactcttgaaggagcctactcttcccactctcccacccccattaagaaccactgtaggccgggcacgatggctcatgcctgtaatcccagcactttgggaggctaaggtgggtggatcacctgaggtcaggagttcgagacaagcctagccaacatagtgaaaccccgtctctactaataatacaaaaattagctgggtatggcagcatgtgcctgtaatcccagctactcgggaggctgaggcaggagaattgctcgaacccgggaggcggaggttgcagtgaaccgagagagatcgtgcggtgccatttcactccagcctgggcaacagagcgaaactccatctcaaaaaaacacacaaaacaaacaaacaaaaagaaagaaccattgtattagtgatggaaatgtgttccctccctcccatcctggcaaccactttcttcctcctccatcataaaatatcttaaactaaactaaaataattttatttatcgatagtttgaattttccctatcattgctacacagctaattgagaggtaccccgaggaaaatataaatggtacagtaatgcattgtagattttaataacatacttgacatcccaaattgttttcattggcttcattttaaaaactacatgttttaaaatcaagcagacactaaaagtacaagatatactgggtctacaaggtttaagtcaaccagggattgaaatataacttttaaacagagctggattatccagtaggcagattaagcatgtgcttaaggcatcagcaaagtctgagcaatccattttttaaaacgtagtacatgtttttgataagcttaaaaagtagtagtcacaggaaaaattagaacttttacctccttgcgcttgttatactctttagtgctgtttaacttttctttgtaagtgagggtggtggagggtgcccataatcttttcagggagtaagttcttcttggtctttctttctttctttctttctttttttcttgagaccaagtttcgctcttgtctcccaggctggagtgcaatggcgcgatctcggctcactgcaacctccgccttctcctgggttcaagcgattctcctacatcagcctccgagtagctgggattacaggcatgcgccaccaagccccgctaattttgtattttttagtagagacagggtttcgccatgttggtcaggcttgtctcgaactcctggcctcaggtgatccgcctgtctcggcctcccagaatgctgggattatagacgtgagccaccgcatccggactttccttttatgtaatagtgataattctatccaaagcatttttttttttttttttgagtcggagtctcattctgtcacccaggctggagggtggtggcgcgatctcggcttactgcaacctctgcctcccgggttcaagcgattctcctgcctcagcctcctgagtagctggaattacacacgtgcgccaccatggccagctaatttttgtatttttagtagagacggggtgtcaccattttggccaagctggcctcgaactcctgacctcaggtgatctgcccgcctcggcttcccaaagtgctgggattacaggtgtgagccaccgcgtcctgctccaaagcattttctttctatgcctcaaaacaagattgcaagccagtcctcaaagcggataattcaagagctaacaggtattagcttaggatgtgtggcactgttcttaaggcttatatgtattaatacatcatttaaactcacaacaacccctataaagcagggggcactcatattcccttccccctttataattacgaaaaatgcaaggtattttcagtaggaaagagaaatgtgagaagtgtgaaggagacaggacagtatttgaagctggtctttggatcactgtgcaactctgcttctagaacactgagcactttttctggtctaggaattatgactttgagaatggagtccgtccttccaatgactccctccccattttcctatctgcctacaggcagaattctcccccgtccgtattaaataaacctcatcttttcagagtctgctcttataccaggcaatgtacacgtctgagaaacccttgccccagacagccgttttacacgcaggaggggaaggggaggggaaggagagagcagtccgactctccaaaaggaatcctttgaactagggtttctgacttagtgaaccccgcgctcctgaaaatcaagggttgagggggtagggggacactttctagtcgtacaggtgatttcgattctcggtggggctctcacaactaggaaagaatagttttgctttttcttatgattaaaagaagaagccatactttccctatgacaccaaacaccccgattcaatttggcagttaggaaggttgtatcgcggaggaaggaaacggggcgggggcggatttctttttaacagagtgaacgcactcaaacacgcctttgctggcaggcgggggagcgcggctgggagcagggaggccggagggcggtgtggggggcaggtggggaggagcccagtcctccttccttgccaacgctggctctggcgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagagggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaagccaaggaagaggaatgaggagccacgcgcgtacagatctctcgaatgctgagaagatctgaaggggggaacatatttgtattagatggaagtatgctctttatcagatacaaaatttacgaacgtttgggataaaaagggagtcttaaagaaatgtaagatgtgctgggactacttagcctccaattcacagatacctggatggagcttatctttcttactaggagggattatcagtggaaatctgtggtgtatgttggaataaatatcgaatataaattttgatcgaaattattcagaagcggccgggcgcggtgcctcacgccttgtaatcccttcactttgggagatcaaggcggggggaatcacctgaggtcgggagttcgagaccagcctggccaacaggtgaaacctcgcctctactaaaaatacaaaaagtagccgggggtggtggcaggcgcctgtaatcccagctactcgggaggttgaggcaggagaatcgcttgaacccgggaggctgaggttgtagtgaacagcgagatggagccacttcactccagcctgggtgacagagtgagactttgtcgaaagaaagaaagagagaaagagagagagaaaaattattcagaagcaactacatattgtgtttatttttaactgagtagggcaaataaatatatgtttgctgtaggaacttaggaaataatgagccacattcatgtgatcattccagaggtaatatgtagttaccattttgggaatatctgctaacatttttgctcttttactatctttagcttacttgatatagtttatttgtgataagagttttcaattcctcatttttgaacagaggtgtttctcctctccctactcctgttttgtgagggagttaggggaggatttaaaagtaattaatacatgggtaacttagcatctctaaaattttgccaacagcttgaacccgggagtttggctttgtagtcctacaatatcttagaagagaccttatttgtttaaaaacaaaaaggaaaaagaaaagtggatagttttgacaatttttaatggagacgggagaagaacatgtagaaaaggggaaatgatgttggcttagaatcctaactacattggtgtttaatataggaacatttatttatataacattttaaagtactaaattcatattagtatattatcaaatggatatattatcaaatgggtttaagcatcctacacattttaattcaattgattcattttctttttgctttggatttctatcatgatttaaatatttacatatgggttactttttagatttttcatactatgaaatataagaaaaacctttaaggctagttttatgaccaagacgaaggacttcattgaatacacaaaacaataaatatactgcaacattttgtctttctttttgtagctgcaatttggtttgcttatactttctctttgtctctttgaaaactgagtcagtttcactttctcaggacaggatttaataaccataatataatttagtataattccttgatttaggcaaattatgcaatttgtgtttagtatgaaatgtacctaaaaataagtaactcctctttaacaccaccatcctcaaactaatataacaaataacagttatcctaaaataaattgtctacttccaccatgcagcactcaaattttaaggttgctatgactgcagacagtattttaaaattcctctctggaaatggctttgtttccaagatgatttaggaaccaaagaggtgaccatctcttgtttaatgaactctcaaatcataaacctgggaagtgttttagtttcctactgctgctgttacaaattatcacaaatgtgttagctaaaacaaacacaaaattattattttacagttctagagatcagaagtcaaaaatgggtccacaaggtttcattccttttggaaactctaaggggcaatctgtttccttgtcttttccagcttctagtgaccatcaaattccttggctcatggtctctgtattttctctgtggcctgtgcttccattcttgtatcttctctctgactgtgaccctctaataaaaacacttggggttatgttgggcccaccctgaaaattctggataatctccctcaagaccattaattaaatcacatctgcaaagcctcttttgccacataagttaatgtattaaaagtttttgaggattaggacatagacattgggggtgggggggcattattcagcctaccacaggaaggaattttagggttaattaaactagccttcttattttatacttgaagaaattgaagttttggaattggagagcattatgctaaatgaaataagccaaacacagaaagacaaatatcacatgttctcacttatctgtgaaatataaaacaattacattcttagcagtaaagagtagaatggtggttactagagctggggggtgggaggaatggggagatggtaatcaagatataaagcctcagttaagatgggaggaataagtttgattgttttttttgagatgtgtttcatagcatgatgaatatagctaaatagtaaatcccaaatgctctcatttgacaaaaatgtcaaatatttgagatgatggataggttacttagcttgacttaataattccccattgtgttcaaagatcataacttcatattgtaccacataaatatatacaactgtactatcccaatatataattttaaaactaatataatgaaaaagaaattgaagttcaacattcccagaagctaagtgtaacttaaaagttttgtgagaatttgttttaacaaacaaacaagttttctctttttaacaattaccacattctgcgcttggatatacagcagtgaacaaaaaaaaaaaaaaaaatctccaggcctaacataatttcaggaagaaatttcagtagttgtatctcaggggaaatacaggaagttagcctggagtaaaagtcagtctgtccctgcccctttgctattttgcccgtgcctcacagtgctctctgcctgtgacgacagctccgcagaagttcggaggatataatggaattcattgtgtactgaagaatggatagagaactcaagaaggaaattggaaactggaagcaaatgtaggggtaattagacacctggggcttgtgtgggggtctgcttggcggtgagggggctctacacaagcttcctttccgtcatgccggcccccaccctggctctgaccattctgttctctctggcaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcaggtgaggactgatgatctgagaatttgtaccctgagagcttccaaagctcagagcattcattttccagcacagaaagttcagcccgggagaccagtctccggtcttgcctcagctcacgcgccaatcggtgggacggcctgagtctccctatcgccctgccccgccagggcggcaaatgggaaataatcccgaaatggacttgcgcacgtgaaagcccattttgtacattatacttcccaaagcataccaccacccaaacacctaccctctgctagttcaaggcctagactgcggagcaatgaagactcaagaggctagaggtctagtgccccctcttcctccaaactagggccagttgcatccacttaccaggtctgtttcctcatttgcataccaagctggctggaccaacctcaggatttccaaacccaattgtgcgtggcatcatctggagatctctcgatctcggctcttctgcacaactcaactaatctgaccctcctcagctaatctgaccctccgctttatgcggtagagttttccagagctgccccagggggttctggggacatcaggaccaagacttcgctgaccctggcagtctgtgcaccggagttggctcctttccctcttaaacttgtgcaagagatcgctgagcgatgaaggtagaattatggtcctccttgcccttgcctttcctttttgtgatctcaaagcatcctccctccgcccccattccatggccccagttccctactcccacagctgtctgctgaaactgccaacattactcaattgtttctggggggaggaacatttttttttgaaacaaaatagatatatgaaacagtacacgggaattaacacgaatatttaaggtaaaacatgaccttgaagattatgaaatccatcttattttggcccagaacgggggcattgggctccttgggccataggggagctggggaggacagggtgaagagttagctctaagccctctgcttggagatgctgtaaatacagaacgcaaaatcaccttcgaagttaaagacgcgaagttcttctttactcggcccctcctcccctcccccccgccaattccctccagttacagctagcatccaggtcccgggaggtgaagaaggagacttcggctccagttacagctagcatccgggtcccgatttagaaggagctgccaattacagcgcggttccagggctgagcaaaaagcctgaggagccaagtgggagagggagtaaaactactgaattgggccacaagcaaatgaataaactgaacgactcttaaccaaacctaatatatttaatccaaacacacaagtctttcatttcttccctcctcccttccttctcttactccccaacaccccctcttcaagcacaattaattatatggttagattctactgcgtgatcagccctgttctaggtggtgggcacgccaaggtgaatgagaccaaacaagagtcttgccctcatggggtttacatttggagacagagtcgatctgttgcccaacctggagtgcagtggcgcgatcacagctcactgcagcctcaaactccctggctcaaggggttctcccacctgagcctcccgactagctgggaccacaggtgcacgccacgacgcctgggtttgtttgtttgtttaatagagacgaaggtctcaccatgttatctgggctcaagcgatcatcccccctcctcctcctaaagtactgggattacagtcccaagctatcttgcccgacctgggaaacagacgttaaggaagataacaatctattttcagagagcgagtttataaaaccaatgcaatgggtaaatatgaagtgtgaataggaggagaagctaaagagtggtcggagaatctaatgcaagctacgggagaaagaaactcaagtgcaaatgctgcctcaggaataaacgtaaaaagagactttcaagtgcaaatgctccctcaggaataaaataatcttgagactctcaagtgtaaatgctgcctcgggagaaccgaacggcgagctggagcccatacgcaacgagattagagaggaaggcagaagccagagcacatgaataaatgagcatccattttgtttcagaaatgatcggaaaccatttgtgggtttgtagaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattgtgagcaaccactgagactcattatataacactcgttttcttcttgcaaccctgcgggccgcgcggtcgcgctttctctgccctccgccgggtggacctggagcgcttgagcggtcggcgcgcctggagcagccaggcgggcagtggactagctgctggaccagggaggtgtgggagagcggtggcggcgggtacatgcacgtgaagccattgcgagaactttatccataagtatttcaatgccggtagggacggcaagagaggagggcgggatgtgccacacatctttgacctcaggtttctaacgcctgttttctttctgccctctgcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactca

SEQ ID NO: 37288 - DNA, 5954 bp, Homo sapiens
ggcgggacctgcggccagccctgggcggccatgtggacagagctgggagggccggaaccagaacccaagcgtgatcctgaaccggagcccgagcctgctgcaggtaactaacgctggtctcccctcggctccctcgggaagccgcagctcctggctccgcgtgggggctttcctctctgggccgcggcgtccgcatctgggggctggcctttccgccgttgcactgtaggactctctccacgtcccctaatcccatcccccgcctctgggtgacgctacaggagccccgaggacacagacgcccccagaccttaccacgttagctcgacctcaacactcctgcccactcggcccacttcaacagagggcccctgaccatagcccagaggcttggacaagcccaaaggttgcgccctttcccccgcagaaggggtgaggtgggcgccgctgcagttcccgcggatagagaaggtccggtccttcccgctgtgggtgaactgtaaaaaattgcctgtattcaggaggatatgcaaagctaggtttgtggaagtctggggtgaggctcctatactttcttgctgtgtgtcctcggtgagtccctgaacctctctgatgcccagccttcttccagaatgggggtcatcatcaaccctgaccacccagggactgcagagaggcttggcaaatttcccgtgagaagacagcctgcaaactgtaaagcatgatgctctgtgagctgtgatcttcctatcagcaagtggaggccccagcaagaaccccatataggccccaagagtaggaacggccttggtgtggctgcaaaggtttgccagccttggcctatgaccacctctcctgactgcttcacccctccaatccttaccccatgggttggtgactcccctttcccctacctccttttggtctcctcaccctcagagccaggcctgttggtggcaagggggctgtgtcccagcatatggcaaagtcctgagctaaatggaaccctgggcacccctggcagatctgctgactcagcttccccctgtgggatatgatgaggtttctcttcaaataatctgatcaatcttttattctttaattcttagtatccccccctttttttttttcatttttctcctttttgcctttgttagatgcccaggcatgccacagtaccaagcgttatcagtaccagctcacattcctttgcttatttggaaagaagactaactttctagctcattacagacaccctttcccctttctctccactttcttttacgtgcccactctatctaaaataaatcaaatgtttagccaaccgggattagtttagattgtacgacctgaccccagccaatggggaaagggtacaggggcaggacttgcatcaggaataaaggctctcgtgcccctttgttcaggtgtgctctcatggcaactggccaaggaggcatccctctgcgcagaagtaaaattgctttgctaagaatcctgtgttcgagtgttcaatttccttaggattttgagcattattcctaacacccgcaaggggaagggaaactttcttggtcagcattgattattattattttttttagatacagtcttgttctgttacccaggctggagtgcagtggcacaatcatggctcactgcagcctcaacctcctgggctcaggtgattgcccccacctcagcctcccaagcagctagaactacaggcatgcaccactatgctcggcaaatttatttttgtttttttgtagagacacggttcttgctatgtgctcaggctggtctcaaactcctggcctcaagcagtccttccacttcggcctaccaaagcgttaccagcgtaagccaccacgcccatcacattgatttttatggggccggggacctacatggagccttgctttcctgattgagttttttgttcctctccctgcccaggggtggagggtgagaggctgggggtgaagggacaggcaggtgcaattccattttaccgctgggcggagcaagactcatgagacatcaaaggcagagagattcaaattctgactgaagaataactgcttcaactaatctgggaacactacactctgtttaattttcatttaatatgtattatatgccgtttaagttttataacagtagttgttttaacgaagtctacactcttcagagttgtagcttttcttctcagctgcctcctgacttgctgcacctctgggaaagctgaaaagggatgctgagacctgtggttgggggatgctgggctaggtcaatttctgaggcacggccagttctgatgtcctgagtggagcttgccagggtttttatatgcaagacatcattcaacataaccccatgaggcatttcacatatgggggaactgaggcacagaggtgaaatgaagcaagtccctctcagagaacaaccatctccaagtccctttgatttctactcaagtcttaggtcaattcttagacagcctttgtggcaatttcagtgttttctcagtgtatcattcagtactgtgtgttgagccgctgctctgtagcaggcatacctctaggctcggggacgtagcagtgaatggaacagaaaaataagttcctgtgctcatggagcttgcattttactggggggagacagacaaacatataagcctgtaaagatagtatttgggatgtgagatagagaaggagtaaagcagggtagcggggatagagagtgttggggtgggaagggttgcaattttttaaagggtggtcagggaaggccttgctgagacagtggcttttgagacccagcagaggtgagggagtgagctgaggataggcgggacgtgatggagttggcccagagagttcatcagggccctcacagctcttacagtctgtgtttttagaggtgacagtcctttatgctggaatcttgaaatgtttgagctggtgggcccttgggtaccgccacctgccttctcccacctgttcaccctggtttcttttgtccctctccagagtgtcagcatgctgcgcttcctggcaccccggctgcttagcctccagggcaggaccgcccgctactcctcggcagcagccctcccaagccccattctgaacccagacatcccctacaaccagctgttcatcaacaatgaatggcaagatgcagtcagcaagaagaccttcccgacggtcaaccctaccaccggggaggtcattgggcacgtggctgaaggtgaccgggctgatgtggatcgggccgtgaaagcagcccgggaagccttccgcctggggtccccatggcgccggatggatgcctctgagcggggccggctgctgaaccgcctggcagacctagtggagcgggatcgagtctacttggcctcactcgagaccttggacaatgggaagcctttccaagagtcttacgccttggacttggatgaggtcatcaaggtgtatcggtactttgctggctgggctgacaagtggcatggcaagaccatccccatggatggccagcatttctgcttcacccggcatgagcccgttggtgtctgtggccagatcatcccgtggaacttccccttggtcatgcagggttggaaacttgccccggcactcgccacaggcaacactgtggttatgaaggtggcagagcagacccccctctctgccctgtatttggcctccctcatcaaggaggcaggctttccccctggggtggtgaacatcatcacggggtatggcccaacagcaggtgcggccatcgcccagcacgtggatgttgacaaagttgccttcaccggttccaccgaggtgggccacctgatccagaaagcagctggcgattccaacctcaagagagtcaccctggagctgggtggtaagagccccagcatcgtgctggccgatgctgacatggagcatgccgtggagcagtgccacgaagccctgttcttcaacatgggccagtgctgctgtgctggctcccggaccttcgtggaagaatccatctacaatgagtttctcgagagaaccgtggagaaagcaaagcagaggaaagtggggaacccctttgagctggacacccagcaggggcctcaggtggacaaggagcagtttgaacgagtcctaggctacatccagcttggccagaaggagggcgcaaaactcctctgtggcggagagcgtttcggggagcgtggtttcttcatcaagcctactgtctttggtggcgtgcaggatgacatgagaattgccaaagaggagatctttgggcctgtgcagcccctgttcaagttcaagaagattgaggaggtggttgagagggccaacaacaccaggtatggcctggctgcggctgtgttcacccgggatctggacaaggccatgtacttcacccaggcactccaggccgggaccgtgtgggtaaacacctacaacatcgtcacctgccacacgccatttggagggtttaaggaatctggaaacgggagggagctgggtgaggatgggcttaaggcctacacagaggtaaagacggtcaccatcaaggttcctcagaagaactcgtaagagcagctgtcagggaggcccagtcacagtccagcaattccacaaccaccttgacgaatgcttgccaagctgttttaaagccaagaacaccctttctttgttccaaattaactcttagaagaaaccccacaaataaagcaattcaatcaaggctgttctatttaaatcagagatggggaccaggctcagagttctacctatctaacccccaaccacagcccccttggtggcccatgagttgcttccatgaaatcttaggagtctctggaggacagattaaaaaccagtgatctgtaatttgtagctcttcctgctgatccaaggactttcccatgggtgcgcttgatggtttagtggatcgactcaactcagaacacaagcttggaaagtgttaggggttttgaactaggtggatactaaatctcggccccactcttcattggcttaacctaaaaaccagaggtgcttttccttgtctgtgtgccagttgctggctgttttagttgcttgcccttcattttgctactgattttccttaatttgtgggaaggagtaggcaaagaatatgcttacatgattacacctgtaaagtaagcccaaacatcccaaatgtccgtcaactgatgagtggattaataaaatgtttccatggaatattccttggattactcagccataaaaaggaatgaagtactgacacatgctgtgacatcagtgaaccctgaaaacatccttctcagtgaaacaagccagagagatgtacaaggctacagactgtatgattccatttatatgaaatatacatactaggcaaatccatggagatggaacatagattagtggttgccaggggatagaggagtaattgttagtgggcatgggatttgtttttgggaggttttgaaaatgttctggagttgaacaatagtaatggttgcatgatttggtaaaaatactaaaaactatggaattgtttaattatggtatatgaattaatttctttctttttttcttttttttttttttttttgacacggagtctcactctgtcgcccaggctggagtgcagtggtgtgatctcgtctcactgcaacctccgcctcccagattcaagcgattctcctgtctcagcctcctgagtagctgggattataggtacatgccatcacacctggctaatttttgtatttttagtagagatgaggtttcaccattttggccaggctgatcttgaactcctgacctcaggtgatccacccgcctcagcctcccaaagtgctgggattacaggtgggagccacaacacccggccatgaattaactccgttaaaaaataaacgtatacattctgtgagc

SEQ ID NO: 37289 - DNA, 5954 bp, Homo sapiens; identical to SEQ ID NO: 37288

SEQ ID NO: 37290 - DNA, 5789 bp, Homo sapiens
accggcccgcgccccgccatggaggacctgggtgagtggggccggatccccgggtccgtggcccctcaccgctgcccagagctgcctccccgccgtcgctctcccgcatctccccatccctgtcttcttacttctgcttttcgcctctgcccgcgcctcctttccaactccacgtcccccttcctgcctctcccttcctgcctttcctgggccggccgctccctcccttcttccctcgctgtgctcctccatcccaggctgcggcagatggaacgggaggtgcggcgcccgcgggcgcccgggcgcggggctctggggagggaggggttaaaggggcctcggcccggggaccgggaaagtagagggcacgggaaagtctggcatcaagttttggagaaaaaaagcgggcctgcctgcaccagagttttgggagaggaggagttaagggctcctgagcacagtgagggtcaggtccttgaggcaaggaagagaatagtaactcaggagtgcctaggcgcccgcgaaggcttcagggtttcacgcgggtgctcagagacgaagactgagggcaggacttctgggttctggaagtgaaagggctcaaaagacccggatctggggatgcagggatggagagaggtgtcttgtccggaagggggacccaggtatctcgtcctccctgcgaagcctggggctggaaggctgtgcgctccacgggagagaggggcttccggcccctggcggtagagggcgctgctcggtaggggtaactgacgctgtaccgcagataaacagccaatcagaaggcaggtcccagcgaagcgccagtgaggagcccagggcgggactcaggggcctgggagtggccaggctgggcggggcctgtgtaggtagagggaggagttaaccagcatggaagagagagcgtccaatcagaaagctgagggccaggcactgggccaatggagcaatttggaggggagccaaatttggcttgggtgaagagcccattttgactgcatcagagaagatggggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctct

SEQ ID NO: 37291 - DNA, 65415 bp, Homo sapiens
gcagcgccggggccctcagatcgaggctgcctccccctctcagccggcagcacattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggaggtaaactcggggacgacgccggaggggtgggggctgtgggcctggggccggtctccgccgggaccccgagtgtggggattaggggcgggagccgcctccaggcctcggggaatggcgctaggggccggcccgtctgtgacgcctctgctagcgcgccgggaagtttatgtcgggcctgctccgcctccgccggggagcgaggtgcccgggtacggccggcgcggcctaggcctgcccggcggagccggcccggcgcgggtgcgaggggccgggccgcgcggcggggaggccgggcgcggcgcgtgcggaggaggcgtgcgtgtgcggccggtgctgccccggccgggccgcggccccttccccggcagtggcggagattccggctctcgctcgggcaccgacgtctggcgccgcgggaaggagggcggtgggaatgggagggtgagcgtgtggcgaccgagtggggctctgaacttcctcagcgaggcccgaggcgtctccacttaaaggcattttttctggtcttcccgactcccgctttacccctgcctccccccaatatccaaactacaggacaacttctccgttgaaaaaaacacccccggcgtgagaggccatcctggtgatcctaacagtgccttccagcggcctgtgttttactctggatatagctgattcaagatgtggctcacggtgtgccctcttccaggcaaaggataccccttatttcagcttgtccacaaatctctttaccccctcctgagaggagaccaccagctgcattcttacatataaagtctaaagggttatacaaagctgtcatcctctagtctacagtatcctttccctccacctgctggtggtggtagtgggggatggggtgggctagggaatggcaccatcacgtttgattatttaaaaaggaaaaaaaaagcttcattgtcttagatacagctgctcccgagattgtctacataaggtgtatgggttaaatacacacatgcacacacgcatacccacacaccccactgagatttttgatagaagacttcttcccttcagcttttaagagtttagataaatagatttaatacttcccttctgcatcttaatcacgagtttagcttttagggaaagtggtcaagcagtattttttatgttgttctcggtacgttttcataatgaaatcttcaacttcccatggcatttctgaacttgagagtctgcttgactgagatattttttgggctttttacaaagctgttaatattatctttaaagtagttcaagcgttttagtgggtttcataatttgagggacgactaagtgtccagggatgttaattctgtggttcttttaaggttaacatattaccattgtgatccctttttttaatgcaaagatgtcacatctttattgagataatttgcatgccataaaaatgagcttcttaaataacaatgatttttcagtaaatttacttgtttatgaaagaatgtggtgaaaatgttttttactaatatgaatacttagaatgagaaaaaatcacaaatgataaaacttaaaaactggtaagtaccacaaaattacagaatccagaaaaatagcaattaggtgcttgacagatccctataacccttttttcctctacatttctggcttcatttttctggcagcttcattgagatgtaattcgcatgccatacaattcacccacttaaagtggcttttagtgtattcgcagttttgcaaccatcaccacagtccatcttagaacattttcacggccccaaaaagaaacctgtactcattaacagtcactctccaattcccaactaccccagccccaggcaaccagtttttgtcttcttagatttgcctatcctggacatcccatataaatggaattgtacaatttgtgctcttttttaactggcttctttcacatagtgtaatgttttcaaggtttatccgtgttgtaacaagaatgtatcaatgtttcatggccgaatgatccttatggccgaatgatccaatgatcctccagctcatggatataccacattttatttatcccttcttcagttaatgaacattttcattgtttccacttttttagctattttacataatactactaagaacatttttgtgtggatgtatgttttatttctcttggctatatacctaggaatagaattgctagatcatatggaaacttactttgaacctttggtggaattgccagactttctgaagttatccttattttttaaattgatgtttcctcctacctcatatcttttggcactttagtcaaaatcagattaagtcctgaggctgtattagaagaatattgtgatgtgtgacttttaaaaaataagtatatattgacattagccaggtttttttgttttgttttgtttagaaattcatagtgccttatggttgtcctctgatgactttgatatccttgtgcatacattaggggtaggaatattttcacttccacctaaggaaataacatatgattctaatagaaagtcatactttgtccacactgtgacttactcaaaatcacatatgcttgtaatgagatagaaacattcttttttatatttagagaacagtacagtggtctactttgtgtatttgttacttacatatctggtctatctctctaagcacttatcagcctacttacatatatgctgtatctctctaaacacttaatcaccctttagatatggttactacattgtgttacataatgtctgtagaatacagcaaattctgagaaaataattgctttttgatttggatcttatgatgacatctatttcatgggaagtcttcagaaagaagtatggaccagtgaatttaacttaatccagtatatccaaaataccatgcaacatctaatttgtgtaaaataattgagacgtttcatattattcctttcatacgttcaaaatccagtttgtattttacggttatggcatacctccacttggactagctgcatttcaagtgcttaatagccacatgtggttagtggctaccttattggaacagcccatgtacagagtatagcatttagggagaggtaattgtagcatattatgatctaacagtttatttgattagaaatgatgaagaatacagagtcctagagtttagtttaatttgatctctaactttgtgtatgaccttggggaaaatcgcttagtcttatggttctttcatctgtaaaactagaggtacttgacatctgcttcatgagtgttgtgaagattaataggtaatgttaggaagatgcctggcaattctctgagcgttttatcaccttcagcttttctttttgggggagggaagggatttaacaagattcagtataattgattctcttactcccttattttcagtggctgttttttctctctgcttgtataacttgttacattgaacaagtaatagggaaaggttttaatacagagacatgtagctgctcattgaagggcagtttaggcacaccaaattagtgatccttttaaagttgtaatttctgagtgttagagttgaaagttattcatagatttcaatctgatatttgttcctacctctctctaccattctgactcctctaaaatgtggtcatgttaagtttcttgaaacacaaacgcaccaaagaaggcatatgttcagtatccatttaaaataattatcaggaactatcagatgatattcaccatggcgtggctgcttcttacagtgttgtagaagatccccagtcttagtttgagaatagtaaccatagaaaagagggtatatacagtgcaacacaggaaatgggtagtgaccaaacttgaaataaaaaacttgtcaggataaagtaaattaagctcatataatttatgttttttaaagtagaggggaattttcttgtagatttcctaataaacctgcatactttttatgaaagttctgagtgtctaggttcaaatagagcataaaatataactagatcttttaaaaacacaactttaagaaaacaacttaccctaaatataaaagaatattaaaatgctacataattagaaacttgtgattatccacacaaacataaaatatgaagtcagcttgaactttaaaaaaaggtgcttggttggcaagagtttaataaattgatcagctgttttgttgttttgaaagagcctcagtgatttgttaaagtgtacagagtgaaaagcattgttaaggtattaagtcttgttaacttttagagactgatctctctcaccacaaatcttggaacatatttactatacttaaaataactactgtctaatttttcacataatagtccaagcatgtgacaatatgaaatatctgatagaaatatagttaggaattaaatgactgtttctgtacttcttgccaactttcctggtttacaaggtagccagtttgagaattgcttcattgatagttttcctggagataccaagatgcccttatttttcgtagtcactaagtatgtcaaatgaatgtacaagattgggaagaattgtaggagtgatttagatttcaaagaatgaagctactttagaaaaaaaaatgcaaaggtagtttttaaacattgatttctaatacctgatagtggttgtgggtccttaaaatatttttaaatgttttctggagtagcattcatctatttgaggcctataatgatgaatgaaacaagagcatgtcatcagatttaaccttgatctctgattttggtacttactcgctgatttagttttggaacagaaaagaggaatatgactgaagggaactttctgagcacctactgtatatgcttttaactgtattcacatttctctcaatcttatacatattgaatttattttaaagaagaaattttaaagaagaaactcttgtgcttttgatttaataagataacatttaagggaatgattttaattcaggtgtgtcagagtctgttctttttgtactttaccatatttcctccatttgacttctttcagccttaatgccagtctcaaatttgatgaaaaggttctatgtgaaagcactgagcatagtccacggggtataataggtattcagtaaatgttttctttttttctcagagggtttttggaaattgtgggtcacttgtagactttcaaacactagaaaacacagtttgttttctgtgcttttcatttaggtttggtaaaagacagggttggagttcttcctttttctgtggttaatatgagaactgtatattgatatctataaaataaggacatttttcaaaaccaaaaatacataatgagaagaatggccatgttgaacctttttttcgggtcttaatgtttggcttaagacagctgaattctcatctgtttctgcattcagtcttttgtgatacactgttttggtcgaagtgtgtgaagaatgtccaccttcacacagacagacagttgaaaaaggaaagtatgttatgttttcataggcttttcaggataattatggagattaagtgatactacaccgtaattctgcaagaggtagtttcttaaagatagttgcaatgtagaatctgaagccacatgagtgaacttttcttacactgttacattaaaatctattggtctgtcttgcacttcagatgtaacatttacccatcttttactgatgctttttgtaataccatgcattggattatttggaaaacattatgtcactgagttatgcacgtcttccaaatgctaacatattttattcaataaaaaattcatgattgttaaccacacaattcagaaaaatcttaagtattgagaatctgtcaggttcacagaagtggatacaagttttctaaaattctaactttctctgggaagctcaatttttttttctttttttaccatgcctctgggacaagttcagaggaagctgaaattttatcattagcaataaatgctataaatggttatcgttgaagccatagactcactttgctcatttttgtgaaaacatcttccaaccattaagtctgaataaccataatttgtctgtcagtcgttttttcaagtaaaaatagtgttccatgaaaaaagtggctaggtcagttcacaactcagttgcacaagtactttttccttgagacagtcgtccttaagtagaagttggtatgcagcagaagtggcttatatgtaatcttcatttttttcacacaattagaaaaggccaatatttaataaaagtaatcattttttactgtttcctcaaggaattcttaagtgagctgacttttaaacaaattttagatgtgaaatcagtgacaactattgcatcttgatgtcattaccttaattcattctaaagcaccagcagtcttacccctatggcatcaattcaagtgttaatacaattttttttttaaaaaaagtattagtattatcattaggaaaatagttttgaccctgtgtactctctgtaaaggtctcaggacccacataggggcccgtggaccatgctttgagtgccactcttttagtttaccattgcttcttttgcacatgagtgtcacttttaattaatacaggctcttaaaggaccttatagtataggggttaaaagacatggactgtagagtcacttaggtctgggtttgaactctggtttctccacttagtaattatggaggctaacttaattatgtctaagcctttgaaatgtttaacaatgcctagcataaagtacatgcagagtaaatggaacctcttactatttctgccaacttacatagtcatacattgcatccaagtaaacccctatgttccatatcagaataacattttgcttacaaaattcctcttgtacctctgtgtgccataatccaaaccacatcatacaaatttgggaaggcttcttattccccttatttaacagtcacctgaaaacctactttctcccacatacttcagccaaattgtcacatacatactagtttatgacttcatttctttaatcctatgttttaagtgggttactaaatgctttatgtagattttgtcactgttttctcaaaacattgtaaatataatcagaaaacaactataattcacactatttagtacccagaatgaaaatgatttaaggtcatagatatttgttggtaatacaagattaagttgattattaaagatgctaaactttcccaggcacagtggctcatgcctgtaatcctattgctttgagaggctgaggcaggaggattgcttgatactgggagtttgagaccatcctaggcaatatggtgagaccttgtctctacaaaaaaataaaaataaaaaatttagctggatgtggtggcacacacctgtagtcatacctatttaggaggctgaggcaggaggatcgcttgagcccagaaagtggaggctgcaatgaactatgaccatgccactgcactccagcctgggtgacaagaatgaggtctcatctcagatagatagaaatttttaaatgctgacttattttctattactgtttatttactattcggacaaaatttagtcacctgtcattttttccctaaatttttatttactttaaacttaatgtaaattagattttaactaatgatgtattttgacaaacatggaatttcatgaatttttttactaacaaaagtcggaatcctaagatagtatgttttttactagttcagtgatggacatattgtctaatattagaaggtaaatcatagtctatctcagtgtcctgttctttaataaaaactttagtttgcacatatctactctttatgttttttaaagtatgtctttctggacccttgaggtaagtgttacataaatttatttagttgagtagttttatcccgaaagacctatgttaagtggtctctgcttggttgtattaaatggccctgtcctgtttgccacctgttcttcctcttcacactggctttttagccactttaagctgttactggtccagaaaaacaagcaagataataccttaaggttttcaaataattgttaacatcactccttgttctttagtaggtgtgaaacccaaatattctccagctctttttaaaatagtgcagaggatttggttccttgaggccgggagtttgagaccatcctaggcagtatagtgagacctcatctctacaaaaaataaaaaatttagctgggtgtggtggcacacacctatagtcctacctatttagggtaggtttggttccttatttcacttttgaatattatgtggagatgttcattttactacagatatatctatagaattgggttcattgttgatcagctgtttcagacaccttaaatttgttcacgttttttctcttaatgttgtgaataatttttcccaattccctttttattctccagctttaaaacaatgacagtacaggttgagcgtccaaatccaaaaatctgaaatccacaatgctccaaaatctgaaactttaagcacctacgtgatgcttaaaggaaacactcattggagcataccagattttggattagggatgctcagtctctaagtattatgcaaacattctaaaatccaaaaaaatccaaaatctgaaacacttgtgttcccaagcatttcacataagggatactcaatgatgaaaagtttaattaagaccaataaacaaataaaaaataggatccgcctcattagtcattagggaaacacagctctaaagcatgatgagataccactttacacccactaggatggcagtatataaaaagaaaataacaggtgttggtgaggatgtggagaaagtggaaccctcatacatgcctgatgggaatgtaaaatggtacggctgctttggaatgcagtttggcagttcctcaaaaagttaaacagttaacatgtgacccagcagttctactaattagatataaatccaggagaattgcaaacataatgtctgcacaaaaacttgtaaatgagtgttcatagcagcattatccataacagccaaaagagggaaacaacttggctgggcgcagtggctcacgcctgtaatcccaagcactttgggaggccaaggcgggccggatcacctgaggttgggagttgggaaaccagcactaccaacatggagaaaccccgtctctactaaaaatacaaaattagccaggcatggtggcgcatgcctgtgatcccagctacctgggaggctgaggcaggagaatcacttgaacccaggaggtggaggttgcagtgagctgagatcgggccattacactccagcctgggcaacaaaagcaaaactccttctcaaaaataataaataaatataaataatttaaataaataaaataaaagaaggaaacaacccaaatacccattaactgatgaatgcacaaagtatggtatatgcatacaatggagtattgttccgctataaaatgaagtataatagttcacccttatctgcagttttagttacctgcagtcaactgtgatcagaaactaggtgaatatgtgatacaacaagatattaatatttagagagaaagagatcccacattcacatgacttttcttacaatatattgttataattgttccattttattattattaatctcttactgtgcctaattgataaagtaagttttatcatagatatgtaggcatagaaaaaaacatactacatgtagagttcagtactatctgcagcttcaggcatctactgggggtcttggaacacaccctgtgcagataagggggtgactattgtactgacacatgcaacggtatggatgaaccttgaaaacattatactgcctgaaagaagttagtcacaaaagatcacactctataattccagttatatttgagaggatatagtaaataaataaataaaactaaaaactctttttcctacactgtcctttcatacagtcactcaacacaatacttctgacaccagatgtgtgggggtttttccccacacaccagctaagcagtcagttctgcaacggacgcctgctgggtatccactgattcaatttaattctgacactgtctacctggagataacatcagatttcaggttgagagctcagtcccatgggagtgtcccccacttcagatggaatcacaagcacaggttatgtcttctgcctctgactgactggctatacatagagttcgcactacctgctccttgggttcaattagcttgctggaatggctcacagaactcagggaagcactctccttatgtttgctgattttttaaaataaactatattacaaaggatacagatgaacagccagatgtggtatgcgggaaggggcactgagtttccatgctgtctaggcaccagcatgtgttctgctatccagaagctctcagaacccattttgagtttttatggaaacttcataatgtaggcatgattgattaaatcattaacaattggtgatcagcttaaccttcagccccttttccctccccagaggttggagggtggggctgaaagtgccaattctctagtcatgtcttggtctttccagtgatcagccctcatcctgaaactatctagggcccccccgagtcaccagtcatctcattagccttcaaaagacactcatcactgcatagattttaaggattttagaagttgtatgtctggaaatgggatgaagaccaaatatttcacagtatcacaatatgaaatgtccaggataggcaagtccatagagacagaaaataaattagtggttgccaggggttgggacagagggaaaagggggaatgattgctagtgggtatggggctgatttttgtgatgttgaaagtcatctggagttagatagtggtgttcaatgcacaactttgtgaatgtactaaaataactgaattgtatactttaaatgggtgaactatatggtatgtaaattatatctcaaagctgttacattaatattaaaaacaacaatagaaaacgtaagagatgagtgggagttgtgacaactttccagtatttgggggtcacagttgaactctaagcagctctttttcactgactttcccttctacccttccctgtattgaattcatttgttaagcaaatatttattcagcatctgtattggaggttctacataatgcaggctgagttcctattcttatgaagtttacattctaataggtccagatctgtaagatctctcagtcagccttaagctggctctgtgggtaaattcaatcagtctgagctagattccttatgtttctttcttaaactcaaatttacaatgagtattacaccttaagtttgaagaggaagaaaagcctaaatgttttgtatctgatatctccttgagatttatgcaaaagcttaatttttaatgtgggaacacctaggattgcatctctttcgttatttgccattaggtaagtttaataatttttttcagcctccatttctgcatctgtagaattaaaatcctatcctagtggggacttgttttgaactaggcttttaagaatgcaaggaacatatccttattcagactaggtcaagtagggatgttagggaagttcagggaccagttctcatattatccaagacatgtcaggtaggattgtcttgatggtaggtgttcatggatctgcaaagttctgctctgccagctgctgtcagctgctaagttttattttcccttgctactgactgtcttagtctttacgtaattctatgttaaattactaagagataatctgactgagctaataagctgtgcccaagctgaagcagattgtttttactcctggcctgcttacggattggcttttcccgagtcaggtgctttcttcccaactcccactaccagtcttctgtggtgtgaggagtataggggtatcacatgagaagtgtaacatcatttgactgcttcttcaggagcacccccggaaagagcagtttcttttagacaaggtggtaaatatgacattatgttagttaatgtccacctccgttcttactttcctgttaactttctactcactgtcataatctggggcaaagcattattgtctcatctccagagtggttaccttgtttctgctattgcctttctccagttcataaaataacctgcatgttttttaaaaaataataataataataaagtaaatcaattctcacctctcctgcttcattagcttctgaccacatttagcttccatactccttactgagaacttcaaggccataccaaatttggtccttgtctacttctccgtctcactctactatctgccttagttacttatactcttattcatttatcttcttttaattccactaacacattagtggtgttctcctcttcaccccttcacacatgctgctctgtctgtgagaatgctttctctgcgcctccagtccccgtctctttccttcatttacatggttatttctcatcctttgaatctcgcttcaaagtcatttactcacagaggccattcctgaaaaagttaattgcaagttaaacccccctgttttccttaagagcactgatgatatatttgtgtgtttactcaatgttagtttctcccgtcagactataagctccctgaaacttacctattttgtacaccactatattcttaagtctcattacagagcctggtatgtagtcagcatttaagtaaatatttgagggaattaaatgaaattttttttttaagaaaacaggagggtactctgattagaattagtaactaaattagaatttttatttttaaggttatcttgtgtattatataaatttatggaatacaagtgcagttttgttacatgtatagattgcgtagtgatgaagtcagaatttttaagtcaattttttctcttgatagaagtaatgcatgatcattgtaaaaacactttttggaaaaataaaaataatcttccatattctcactactgttagtcttttggattgtttcctttttcatgtgtacatttttccaaacatatttgaacttaatttgaattctcatgagagtaactcattagaatacagcaaaggttttcatccttggcactattgacgttttgggccagataatttgttgggggatgggggagtgtcctgtacactgtaggatgtttagcagcatctgtggcctctacttactagatgtcagtagcacatcacccccccccccccagttgtgacaaccaagaacagtcttcagaaattgccaaatatcccttgtgtggcaaactcaccccagatgagaaccattagaatacagttacttcagtaaacttcccagaacatcattgctgttttcacttctcaacccagaaaccttcagtggcttcctattatctctaagaggcactgaaaagttcttaattagctaggcatttcaggctctcaatttggtttaacagatatttgagtgtttgctgcataaatgctagtaaaggtataaaagtgaaattacttgtccaaattaattcttacctttttagttgataactccccatccaactaacttcatctctgactctctacttcaggcaagtgaacccacctcacatttaacattcagttctgctttttctgtatttgcttttgttgggtctctcctggaaacaccttctagtctcccctttaccttgccgtttcttatttgtgcttccagatagaacttaaacctccacaactcagttaagttttcactaatcacatcaattcatatgaatcttccctttcctgaactcttagagcagttatttatgtacctatattctgatattttcttctgtaagacagtgtttttacttttcatatgtttttgtagagaaaagagtattacaaaaggatatgtgtggcttgtatgccaacaacttggataacctagatgaaatggataaattcctaaaacacataacctgtcaatactgaatcatgaagaaatagtaaatctgactagacctataagtagtaaggagatttaaaatctcccaacaaagaaaagcccaggatcattggcttcactggtgaattctaccaaacatttaaagaattgatgccagtcctgctcagactctttcaaaagatggaagagttccaaactcaaggccagccctactctgatactaaaaccagaaaaagacattataagaaaagaaaactacaggccagtagccttgaggaaaatggatgcaaaaatcctcaacagaatactggtgcaccaaatccaatagcacattaaaaggatcacataccatgaccaagtggaatttatgcctggggtgcaaggatggttcaacatatgaaaatcagtatgatacaccacattaactgactgaaggacaaaaatgacacagtcataccagttgatggaggaaaagttcagtaccagactttgacaaaattcagtgccctttcatgataaaaacactcaaactaggaatagaagaaaattatctcaacataataagggccatatatgaaaagcccacagcaaacaacatattcagtgatgaaaaactgaaagcttttcctgtaagatcagaaataaggcagtggcggtgtgtgctggctcatgcatataagtccagtgctttggaaggaggcctcagtgggagaatcacttgagcccaggagttcgagagcagcctaggcaatatagcaagaccctgtctctacaaagaaaaaataaaataaaaactatccaggcatgcaggcatgcacatggagtcccagctacttggaaggctgaggggggaagattgcttgagcccaggattttgagactgaagtgactgccactgcactgcagcctgggcaacagaataagactctttcaaaacaaaacaaacaaggatgctcacccttggcatttctcttcaacatagtactagaagccctagctagagcagttgggcaagaaaaagaaatgaaagacatccaaatctataacaaagatgtaaaattatctctgttcacagatgacacaatcaccctaaagattccacaaaaatgattagaactaataaatttagcaaagttgcaggatacaaagtcaacatacaaaaaaacagctgtttctatacactaacagtgaacaatctgaaaagggaattaagaaaatctcatttccaatagtgtcagaaaaaatacttaggaataaacctaaccaaataaaagaaaggcttatatgcaaaacattgctgaaagaaagaaacacaaatggaaaacaatccaatgttcatggaaaacttaatattgttaaaatgtccatgatactcaaagcagtctaaatattccattgcaagccctatcaaaatcatggcagcattttttacagaaatggaaaagcagtcttcataaggtaccacaaggactctgaatatccaaaacaatcttgagaaagaacaagcctggagacctcatgcttccagactgaaagacatattacaaagctactgtagtcaaatcagtatggtgtactggcataaagacataaacagtggaacagaatagagagcccagaaatgaacccctgcatattcgggcaaataatctttgacagagataccaagactacacattggagaaaggatagtcctttaacaaacggtgctgggaaaacttgatatccaccatgcaaaagactgaaattggacccttgtactatatacaaaaatcaactcaaaatggataaaagacttaaacataagatctgaaactggtaaactagaagaaaatagagaaagttttataactttggtcttggcactgatttcttggataagacacttaaaagcaaagctataaaagcaaaaatagacaagtggaacaacatcaaactgaaaagttgatgtgcagccaaggaaacaatcgagtgaaaagacaacctgcagaatgtgagaaaatatttgcaaatgatgtatctgataaaggattagtatccagaatatataaagaactcctaaaactcaacaatagcaaaaaccaacaaccctattttaaaatgcgcaaaaggcttgaaaagatatttctctaaggaggataaacaaaatagccagtaagcacatgaaaagatgctcaacatcagtaatcattagggaaatgcagatcaaagcaactataccatctcccacccattaagatgactactatcaaaacaacaaaaacaaaataactgttggtgaagatgtggagaattcagaatcttgtgcattattggtgagaatgtaaaatggtgaagctactatgaaaaacaggatggtggttcccaaaaagtgaaaaatagaattattatatgacccagcaattccacttctgagtatatatccagatgaattgaaagcgggaactaagatacttgtacactctagtttatagtagcagcatttgcagtatccaaaagtggaagcaaaaggttatttaatgtataaaatagatagataaaatgtgtatgtacatacagtggaatattatttagacttaaaaaggaaggaaattctgacatattacaacatggatgaaccataagcattatgccaagcgaaatatgccagtcacacacaaaaaaatactgtataattccacttatacaaggtacctagaataggcaaatgcatagaaacaggaaaaggaataatggttgccaggggatagagggaaggagatagggagttgtttaatggatgtagtgtttcgtttttgcaagaccaggatagttttgggagatttgatgcacaacaatatgaacattcttaatgctgccgaactcactttaaaatagttaaagtggtaaagcttatgttatgtgttttttactacagtttttctgaaattttctaaattttaaagtggttaagatagtaaattttattgttatgtatatattaccaccaccaccaacaacaacaaaaaaaaacccagagcactaacaacaccacatgccggtgaggatgtggagcaacaggaactctgattcattgttggttgggaaggcaaaatggtacaatcactttgagaggcagtacaaaactgaacatactcttaccatatgacccaacaatagcacgccttggtaattaaccaaatgagttcaaaacttatgtccacacagagcagctttattcataattgccaaaacttggaagcaactaaggtgtccttcagtaggtaaatggataaattgtgatatatccagacaatggcatattagtcagtgctaagaagaaatgagctgttaagccatgaaaagacatggagaatcttaaatgcatattgctaaaagaaacaagacaatctgaaagactgtatactctatacttccaactatatgacattctttaaaaggcaaaactatagagacagtaaaaagatcagtagttgccaggggttgagggtgagggagatgaataaggagagcacagaggattttagggcagtgataaaatactgtttgatactaatggatgcatatcattatacatttgttaaaacctgtagagtatgcgacaccaagaatgaaccctaatgtaaattatggactgtgggtgatagtacatgtaggctcatcagttgtaacaaatgtaccattctggtaacaggatgttgatgtagggggaggatttgcctgtgtgggggcagggaatatatgggaactgtctgtactttttactgttttcctgtaaacctaaaactgcttgaaaagtagtcttttgtgtggcatggtgtcattcctgtaaaaatcctaaatatataaaattggtgatatgcagtagaaacaccaaaacacccatgagaatctaatcaggcaattaattaggaaaatggttgcatttggcagagaaaaataaggggaggagaggattgtgaataaagggagattttagcagtattcataacactttaagatttttatttcttcaaaaaaaggcaaatatgacaagataacattaatacattggatgtcatgaaatttgtttgtatatttgacatttcatagttggactttttaaattcatcttatagaattggttaatttgggattgcacatgtcgcctacatactccactgactagttagttgaagggaaccattatggtcagtttacacagatttagtcaaaagctcaccctggaaacatcaccagaaatgggaatcgctttgcagtgtggcttaagagaccaaagaagggccggagagtgagtttcatttccattttgagaaaatttaatgttttgtagataccagggctcagttttagttttgtaacttattcagttcagtactataccacaataaatgagacgtgggttagaagctctaagtcttgagtggtattttaagcatattaaatagtgtgcagggatgggaataatggtagcagaaacagaccagaattcagtagatgaggggtggggagcgatatcggaacctttgtttatccaaacaaaggttggtgattaaccatattagtttataaagtaaatgtacgtttagtaatcctcatcttatttgacatatccccaacactggatgtagttgattgtggttccttaaaaaataatattttcacttggttccatattctcacagattcttctttttttctgagatggagtcttgctctatcacccaggctggagtgcagtgttgcgatctcggctcactgcaacctcggccgcctgggttcaagcgattctcctccctctgcctcccaagtagctgggactacaggcatacacctccacacctagctaatttttgtgtttatagtagagtcagggtttcgccatgttgcccaggctggtcttgaactcctgacctcaagtgatccacccgccttagcctcccaaagtactggaattacaggtgtgagctgccatgcctggccttgcacagattcttgactgccttctatctcactgatttctctcttagtcttgtaccccttattttgtggtgcctcaggttatgctcattttgcagataatctcatctggtgatctggttttaaatatttggacactgacaactttccaaattgatatttttagtctcagcctctttcttgaactcaagattcaacagactacttgacatctcattcgatgcattatcagtaccttaaacttagatctaaaagtgatattaccccccaaaacttgctgatcagtcagtctgccccatctcagtaaatggcagttccatccttcagttgtttggatcaaaaaccgtaaaatcattgtttcctctccttgacagttctatccagtctgttagcaaattttgcaggttctgtcttcaaaatatattcagactcattatgttttatgatccccactgcgaccactctggtccaagatattatctgttgctgggattactgcacttgtggtatattcccaacacagcagctggagtaattctcttttaaatcagaacatgtctctcctctctcctttgctcatcccccagtggcttcctagcgcacttcgagtaaatgccaaaatctgtgcagtggctagcctccatttcctacccctctttgttcattgcatgtcagctatccacctggcttgatcactcttctcaaggtctttatttaaaaatgtccttcctggctttatatttttctgtctaataccactgaaacactatacattttaactttatttacagtctttcacactaaaatgcaataaatgccatgaagacagagattttgtcattttgttctgttttctccttaacactcagaacacttgtggtcagtaaacatgtgttgggtgaatggtttcctatgcacatgcatacatctgtttagtatgtgaacataactagagggcttttaaaatagtgctttggcaaagtaattcagtaatttacctttcaatgaagatttttctgttgctaagtttaatgtctttgacataagttcacaaagaaaaagaatattttgaaagtaaacactgaagagaaaaagagaaggaaaaatagcttatttgaaggaatatgtaatagaagtagacctagaatgaaaaagtaatgtgatgcagtgtaaagaatattggactggatccaggatatctaagctttggtattcttgaagtcgctgggccatagttcctttctccataaaatgaaatagtttaaatgatttctattctctccagttacaaaatcctataatactatttgcttaaatttttccgtaagaaaaccatgagtttgagtttattatgttcttataacatagaaggaaaatgttcctcaatctctcttgcttacacatttggtatagttttgtaaatgggaaaaaaaaaactatttttctcatctgaaaatgcaccaaatcagcagagaaatcagattccttcaagcagtaatataaaagcttgggttctattgaccttcttaatttgggtatatctcatttcttctcttactcttcttcggtaatttttctcagtgtcttttcccatgagttgagttttcttcaagtcactcaaacagtttgtgaaattttatttcttctgttaaggattcaaagttttttgttttttgagacaaagtctctctctgtcacccatgctggcatgatcttggcagggagtttgaagagaagtgatcattcttggtagcatttgatcaattcccttataacccattaatcttagagtaccttcctttgtgctcatataaaacttatatatgtgtttgtttactagagtagatttatttataggttgtcctcagtcgccttctataagtgattctgaaagtttatcttgcagtgtttcccaaccctgagaaggttatatgtgtctcaccaaacctatggtcatttctaacctcttttctttccctgttgaacaccatctgtttgccagtgcgcacatatacatgaacacacacacacagtttggtaattgtctctgctaccaaaactagctattgaaaggtcaaggaggccgggcacagtggctcatgcctgtaatcccagcactttgggaggccgaggcaggtgaatcacctgaggtcaggagttcaggaccagtctggccaatgtgataaaaccccgtttctactaaaaataccacgccacactgggcgtggtggcgggcacctgtaatcccagatactcgggtggctgaggcaagagaatcacttgaacccaggaggcggaggttgcagtgagctgagatcgcgccattgcactgcagcctgggcagcaagagcgaaactccatcttgggaaaaaaaaaaggtcaaggattcccatgtccttttggcatcacagcataacttaaggcaagagaagtgcaagatatgaaaacaccaagcaactgtaccagagccacaaaatagctcttgtttataattttgagttatgactttttcatgattcttagcatagaaactacattgccatgcatagtaactacaaatgacaattacatattttttgacattgttttctaaagttgaaaaaattggctgggtatggtggctcacacttgtaaatctagcactttgggaggccaaggtgggtgattcacgtgaggtcaggagttcgagactagcctggccaacatgctgaaaccctgtctctgccaaaaatacaaaaattagccaggcttggtggtgcacacctgtagtcccatctactccaggcaggaggatcacttgaacccagcaggctgaggttacagtgagctgaggtcgcgccactgcactccagcctgggtgacagagtgagattctgtctcgggggaaaaaaatgatacagtttttgaggcataaaagatctcagagatccattgaattctctttacaagtgaaggaattaatacccgtaaaggtcgtgacttgcctatgatttcattaaaggtagagctgggactagtagccatatgctagtagagtagtataaccatatactaggaaatcatcctgggaggagatgtatgcatttattttctcttctatcatatgtaacctcgtgcaaaagatagaagaatatagagaactctgggaattcagatttttcccttctttattttgtgacttttccaaatagacatgtataactttttaatttaatacattttcctgttgtttgaatgttgaagagatagtgaaactctaatccttttctttggagttaacacctaacagtttcttacattttggcaatttttaaaaattatatttatgtactaataaattttcaatgcttacagtttagatatggatcattttaaagtatggaatctatagactagaattatttcttaatattgctccaatagcttgcctagattaagtctgacctcctacactcaatgtattttcagacttctcttcacttatgctcagtgtccattaatcttatcacttcttaaagagataagaacttgattctgcttgagaagacttttgcccatcactagtagaacttcaggcctttaatactagtgttaataagtgctacctgtgagaaataaatctacagattgaaaatttgaactaaacttacttcttaaatgaacttttctaaatgaaggattgtaatatgggtttttatccttaggagatattaattattgacccacttgagtaagcatttaacagtgttaggcatttaaactttcccttttattgtcataatgtaatttatttgctaattacatgcagtttgccaacataaatactatttgacaaaggcatgaataagcaccatgatggttgctgctgcagagagagagaaataagaaataggaaaacatacttttctagttatgctgttttagcttttggttcaccatgtaatcgggttgaacaactgttttacctaccaaatgtgtttgggttgtgatgataatttgggttgaaatcaccagtaactcacttttctctagaaagtatagcttagctttatgttatgtgattgatttgtctccttgcctacctgttcatttctggcttctgatattcttcagcagattccacacatgccatctttcatagttctctctttttgtacatgctatattttctacctggaatgcctttctctaaatggattgccgttcagtcttaaaaattaagcttacatgttatctttagtaattaccctctttactgtcagagtgcgttgtgtgcatgttattaatacgtgtattaaataagtacagtcaagtaacatgtttagaatggtgtttggcacttgctgtttgctaagtttgggccttattactattttactaagttatatttctgtatcagaagagtgctacctccttaagggcatagatatgcagtgtctggtccatctttgtatttctaatgcttggcaattaggtgattaataaatgtttgaatgaatgctttccaggagtctctaaattagtaatactgttaactcatgttggggagggaaggcgtgtgtgtgtgtgtgtgtgtgtgtgtgtgtgtgcgcgtatataacttttaaaaaccgctttattacctctcataaaattcaccaattttaagtgtagaattcaatgatatttagtaaattttcatagttatgcaaccattatcacaattcagttttagaatatatcctagtcaccacacagaagatctctcgtgcctgtacaaattttttaattcttattttcttttttttttggtagtgctgttacctaagtattaaccttcccaaggtatcaatgaaagtcaggctgggtgaaataaaatgaagacattgtatttcttatctttgtattatttagaaagaattttctttaacatttttctctagtgagattgagtcctaactaaatcctaactttgctcaagaaaatttaaaatatccaaaattgtacagtaattactatgtcatattttaaactaacaatttttagggctttaaagaaaaaccatgtgttggtaaaactgacttgaaaattagcaggaatcaagtagccactaatcagaaattaaggagcaattaagtggaaagaaaatactagaatctacacctcattaaagcagggtaagtgtttagtccctagtgcttaatacagtgatggatgcatagtaaatgttcattaaatacacaaactgcattccttttaaatagagctagcattctgttttgacttgcttaaaattttttgtcaatttcttatccccttttgcctgaatttataattttataactgtttgacaagcaaagaaatataaaatacctgagtgatctgcctaaactctacccacctcctttgaggaaatagcagcaacagtcctcaacctcccccacttacagtcgctgtcctttatatagctctctggcctatacataagcctttggccagtttgtcagctttctggaattctaattgacaccactgcttactgcatcagtgtaagtcatgtgaattcacaactaatatattttcatgtagtatacaaagcctgctctttaaggacaggcttagaagtcttatatatccctttcatggggtcccgaagaacaactattgtttggagtaaaaaacatgcccaaatgctgccaggctgtggtgcatagggtgtctttctaccagttcattcattctctaccttggagaggaaaagaaaacccttgctctataatgaagggattgtcaaatctcttattttgcaaagtttctgtgaaagtggtaatagcctggtcttatgttgttactacagtgctaagttggtttgataaatgctttattagtagtttcaaattatcaaaaaacctccagactttgttgtaacaaatgagtatcaagtaaaaagaaaatctttcgggtcaggcgcggtggctcacgcttgtaatcccagcactttgggaggccgaggcgggtggatcatgaggtcaggagttcgagaccagcctggctaacacggtgaaaccccatctctactaaaaacacaaaaacttagccgggcgtggtggcatgagcctgtagtcccagctactcaggaggctgaggcaggagaattgcttgaacccaggaggcggaggttgcagtgagccgagatcccgttactgtactccagcctgggcgacaaagtgagactccgtctcaccaaaaaaaaaaaaaaaagaaaagaaaaagaaaatttttcgtaaatctctggatttaataaatgagatgtaatataatgggagaaaattttttggagtaaacaaaacatttatgtaaatatgcagtatgtagttgtttgggatttatttaatagtatgctctaatgaaaagaagttaaagcccattataccttaatcctcctactttagatgaagtgattgctaataaaaactttccttagactggaaatacccagtccctcagaagtctaccttatttatttgttgaacagtcttaagtaatgcatcctacagatattgttttctgtgcctgagacataggtcatagttttttgttactagaattgcttattgatttcatattgtgatattatgcaaagctcattgtgttggtaatactacttttgctttagtgtgaaccattggctctccaattcacttgaactctgacttcgagaagtgtggaaaacaatatggcttagtggttaagtggctttgtgtgagactgtctgggttgtaatcctagccacctttggacaaacaatctaacttctctaagcctcagttttcttatttttaaaaagaaataaagggttgttttattcttacctcataaggctataatgattatatgagatagatgttaacacttaccgtagtatttagctaattatttttactcattttgcagcctattttgttattttaacattgactcctggtgttttaaaaaatctatatctgtaccaaataaagttgcatagtatattagaaagtgataaatggtatagagataaataaggcagggaagagagagagagagagaaagtacccaaatagagagttggcagatggtcaggaagggaaaagccttcccatagaggtaaggaactgagcactgcaggtagtaggggaagagcattccaaactgaggaaatagcagcagcagtaatactaagctaacacatacactgctgtgtaccagggacagtttaagtactttacatattttagctgatttaatccttaacagcagtcctgtaaagagggtgtttttactatcccaattttatagataaggaaactgaagtgcagagagctagtaagtagtatggctaaaaaaattgaacccaggcagtttgactttggagtccatcttctgagaagttactgtatagtgtattagttaaggccttgctacaagagactttacagtgtgttcgagaaatagcagagttggtgtgagtatagcagaatgaatgaagataatggtaggagctaaggtccaagcagtggtatttagggaaggaatgaggtgggaagatttgactggacgtaagccactgtaaagactgggcttttaagtccgaagtggagcgtgtgagagtctttggatatttttgaacaggaggatgatatgatctgactttttacaaaatattttttactgattccttggacctttccttccttggagtctatgggtagaattcaggagggcccctggaatttagaagaaattacatctttattttcactaacttataactgaagcagtgtttccttcactcaatgtagccagttaaccatagtaatattagaattacctgtgactgttaccaccaataaaaatcacctctttgttgcatttatggtcgtcattactttgaagttatagtagttactagacccactgctagatcccatttaatgtgataataaagaagcacttacattacatttttttatatttacagctcttttttttacatttatgtatcaagatagtttcctttgtaactaaatatgtatatatatgtacatatatacacacatatatacatatatatacatatatacatacatatatatacatatatatatatagtgtgtgtgtgtgtctgtatttaaaaacactatctgagaaagtatccattgattataccaaactgccaaaggagtccatggcacataaaaattaagacttcctatgaggattactctggttgctgtcattatactagactctggaggaagacagagggtaagagcaggagggctacatgttaggagactttcacagttatctagttgagagataatggtacgttggcccagaatagtagcagaggaggcagtgatatgtgtttggattgtatgtcttgaaggttgaaccaacaggatttgctgacagattgaatatgtaatgtgagagaaaaataatcaaggatggctccaaggtttttggtctttgcagctgcaaggatggagttgccatttgctgagatggcaggtggagtgtattaaagatcaaaagttcagttttggatttaagtttgtgatatttattagacatctagtatgactttctgagttgttaccgctacgtaatacacagtcattagaaagaataaggtgaacctgtatgtaaaaacagattgaacttatattgtttctgaacatttgaatgttttacagtgaacacacatgcctgtagtaagtaacttaaaaaatgagaaaaatatgtttaaaagtaaaagaatggccatggtgtgccatagaaaattgggtgaccatgaaaaataataaaataggtctttatacaccaccatggaatatctctaagttctataaacaaagtaaaccaaaacaaggtaaaaaacaggatagatagacgtgtcagaatcatggtaaatctaacagtgttttctatgagataaggaaattgtgggtgagcaggagggctcctttggctttttttcgctttttttttttaaatagttgaatttactaatcttgtacgtgtgttattttttgtaatatcatcggttcatatgaggggtgagattatgggctcttttattctttgtacctctgtatttttataaaccttatattatagtttttaaaattgtgatatagccaatattgtattaataatttcaaagagatttttcatgttttgcaatatgaatgggaaatgaagattgaaaatcatctacatagtatgatttttattatgagtaagatttgactttatatccatatggctaaaagaaaagattagaggtgtatattgaaatgttaatagtggttttctctggataatggaatttgaggtgattttaaaaatattttcctttaatttttttgtagactatgagaagacaacgaaatgaagttgtagttgaattaaggaaggtgagtctgattaatattgggtacttctaagcataattctaacaacattatagcattatatacaagatgccaaatatatattatgtttttaggtaaaatgtataacctattgtataactaaattttatttactaaatttagttaaactttttaaaatctcaactgctaagcatttttctttagaaaaaggagagattttgactaaatttgacaggcttttgaagttgaaaggatacaactagttacttgttcattatgcaaaaacagatataaagaacttaaagtataagtcattgagatacagttgtattaaatagttctgctattaatgggcagtagtaagtccctgaaaagaacttgttgcaaacttcttcaacttttaagtattatagttgagaatatatttataaatttgctccaagcattttaagtgaagttgaaatggcccttgatttttgtaagacattgttggtttttgtctaactttgaactgcccaacttctgctttgactttgcttttaggtggtaaagaggagctcccagatcatgtataaaatggtttagtacttttaaataaatatttgtgtttggttctggcttaaactgtacactatattttttagtcaaacttttgtttttgttttgttttgtttgtttttacatagttcacggttcattaaaaatgtaatatttgggaactgggactcaaattagtgttgcgtgagtggttaattcacagtttggtttaattttttacatttgaattttacttttaaaaggcacttcatatttcagtttttaggcacaggattgcctgagctttgtatgaaagtattcaggttttctttttaactcaaattctctgtttggtttttttttttttttttttttttttaagaataaaagagatgaacatctcttaaagagaaggaatgtaccacatgaagatatctgtgaagactctgatatagatggtgattatagagtggtaagtcattgttattgttattctggtaacttaaaagtacgagtgaaagatttcacattaataagagaattttaaggtgactttttaactgagttttctctttaacttttttcccagcaaaatacctctctagaagctattgttcaagtaagttggattttttccctctcttcatttgcatttcttgtcctcaacagctaatcgtgatatatttacatcataaattattttattttttatagaatgcttcaagtgataaccaaggaattcaattaagtgcagttcaagctgctaggtaagttgaatttggaagacatgtttagattttacaacttacacaggggttctattttgaatttttactattgagtagtccctgttaatcaaatttaacttgatgacaaacaatagtaaatagtaatagatcaactaaatttatttttttaattctgtggtttagaatattaaaattggtgacagttttttaaacaatttttatttttagttgaaagtgtacactgaaggtttaatatacataatgcatacagatgccaaggaaagttgatttaacaaattaatgccatagagtaagagaaaaacattatttgtaaagctttaccttttactaatgaataggtttaattttataaagtcagattcttcagatccttaccaggtatcttaattcttctcacaatcctcatattgatcaaacaataaatccagaattataatgttactatgtcagtgtacatagacaagtagatgtagattaagattaatgacggccgggcgaggtggctcacacctgtaatcccagcactttgggaggccgaggtgggcggatcgtgaggtcagaagtttgagaccagcctggccaacatactgaaaccccgtctctactaaaaatacaaaaattagcccagcatggttgtgggcacctgtaattccagctacttgggaggctgaggcaggagaatcataactccatctcaaaaaaaaaagagattaatgactgcatacactcccagtgtctttccaggtaggaaataccaagttgtttgaacatttctttttttttttttttttctgagatggagtctcactctgtcgcccaggctggagtccagtggcgcaatctcagctcactgcaacctctgcctcccgggttcaagcatttctctgcctcagcctcccaagtagatgggattacaggcgcccgccaccatgcctggctaatttttgtatttttagtagagacagggtttcaccatcttggccaggctggtcttgaactcctgaccttgtgatccacctgcctcagcctcccaaagtgctgggattacaggcgtgaaccaccataccctgcctgttttgcacatttctattgtaaaacctatgctctcatattttaagggaagaggcagaaaaatctattactgagacctttgtattaataaataggttggggaagacatggttgtatcataatgcaatttagtggttgctttgtatatttatgaatataagaataacaccctatgttgagtttatcagtaggaaagagacaagtaagaaactgatcctagttacagaatttgaaagtggaaaaagtttgtaggtctatccaataccttatccagtgctgcacgaatctgttttatatttattagacttttccagtatttgtttattcaccttaaataacttagaactgatagggaagttataaaattacagtattgtgtaccagaggtaaaagaacttcttagagaggaattctttatgtaggcagaaaaatctcagaaccattcacattgcaaaatagcaaattaatgtttataggaagaatgattaagaaatcgattatgctcaccattgtcagagttgaatattggatagttttgggacagttcttctcaacatgcaatctgcaagaaaattaaagcccagtgtaccctaagaggttttcaaagtatgatctgtggatcactgggagattccaagacaatttcatgggtatgcaagagcaaactgattttcaaaataattctaagacttcatttgcctttttttcactgtgttaatgtttacactggtattgcaaagcaactgtgagtaaaattgcgggctccttaatgcaaatcaagacagtggcaccaaactggttttatattatattttgtaaaaattatattattcaccattatgtaaagaataaaagacatttctcttctaaaatatcctcagtgaagtgtaaaaaaaattttttaaattaaattttgacccttgatctcatgaaaccttgtttgagaaggctgggttaagacttcttcgaagtggttttttttttttttttaaatttccacttaatgctaagcactgtgccatgtgttgaggaaatagcatgtggtataattctttctctttaagaactttataagctaattggaaaggcaaaactgtattttaaaaaatagggggctgggcgcggtggcttaacgcctgtaatcccagcagtttgggacgccgaggccaggggatcacttgaggtcaggagtttgagaccagcctggccagcatggtgaaacccccgtctctactaaaaatataaaagttggctgggtgtagtgtcacatgcctgtaatcccagctacttgggaggctgaggtgggagaattgctcgaacctgggaagcagaggttgtagtgagccaaggtggcaccactgcactccagcctgagtgacagactgagaccctgtctcaaaaaaaataagtagtgatagcaccaaacgtagggctatgctgtataaatcctcttgaaattcaaagatggtgttatgtaaaacatagaacttgaaatggactttgaatagagtttgaatacatagaagaccgggcatttcaagtgaggggtttaggataggttcagtcttatttcagttgaaatgctgtgacagacaactaacctattgtttagttacacagaataagattagttataagatggagccaacttgtgaagtagtttaaagctaggtcaaggagtttacattgataaaggtagtaaataagcagccatcacatagtttatatagggaaatgatttggttaagctttcataaacattgcttttatatagtaatacagggtgttccagtgggtaaagatatgattaggccacactgaggacttatcagctaaacctgtagtctcccacatgtgaaaatagacactaggttttgtttttatcttataagctccatgagagcagtgatgtgtctgtcttttttacctcagattctctagcatctctctggctgttttcctatcagttgctgtgcttattccatttctctttagttgctgagatgaaaatgttgttgaacttttatggccttaaatttggtgtgtaaagtagaaggaagaattagggactaatatcagctataacatatttcagcagactacctgcttttgtcatttgactctcttgtgacctagtgtgaataattttggatattttggtgacctcttaattcctttcttagcaaggtaaaagctgtgttgaagaaatctgcccatttttttctctgaactcaaaattatgtccaaaagtaacatgtattttttaaaaattagttttctttttataagtcacaatcaggactttactgagggaataataatgttgtaccattaaaagtagtaaagtggccaggctccgtggctcacgccggtaatcccagcactttgggaggccaagacgggtggatcacctgaagtcaggagttcaagaccagcctggcaaacatgaggaaactccgtctctactaaaaatacaaaaatagctgggtgtggtggcgcacgcctgtaatcccagctactcaggagactgaggcaggagaatcactggaacccagaaggcagagcttgcagtgagccaagactgtgccactgcactctagcctgggcaacagagtgagactccatctcaaaaaaaaaaaggtagtaaagtggttcatatctacattcttatttttctaattatttgtcatctctataaatttaatttgtatatctttttataaatttagagaaaaggttgcattatataaattgttaatttcagagaaggcacttgtaccaaatattcagatttatgttaatatttgtcaaatatgaatttatatttaatcataatattgtatgttattaagtttcacaggagtgtttttatctcttacaggaagcttttgtccagtgatcgaaatccaccaattgatgacttaataaaatctggaatattgcccattttagtccattgtcttgaaagagatgacaagtgagtacattatttatttttttttttttaatttagaatgtatcctttggagaagacaagactctagtaattagtttgatctttaaagaaagaagaaaagggctatgggatggagttgaaaagtcaaagtgaaaagcagtgcaaggtttgttaacaccaagagatgaaggtagtagccaaaaaaggaacttgagaatgataaatttaacttttatgctttgaaaattggcaagaactagtttgaccagataggtacttgagaaaactgtttggggagtagtatgcaagtatcttaaaaaagatttcttactaaaaatcaggatgctggaggaggttgtatgctttttatactgaagagatgttttaaacagttgttgagggttaaaaaaatatgctggatggatagataacttttgaaacaaaatatttaatgcattttaaatggtagaaggaagaatggttagatatttggcccaatgtaaaaatccctgctgtttaaaaatacttgtttttttttgtagtccttctttacagtttgaagctgcatgggctttgacaaacattgcatctggaacttctgaacaaactcaagcagtagttcagtccagtaagttggttattaataaacataattgtgattttttttaaaagaagtcggtaaaaaatagtgatcttcccaaaagactatggcaatttaaattataaaataatagctactacgtagttattgaaataggtcaacttaagtatgttactttaatcttcttattctggtgactgatgttttttgtatttccaaaaattcacttgattcctttctaaatatgagaacatttcctaattatagtagcagattacattattattgttacactttatttataggacatcagtagaaataaaggagtttttcctgttgccacattgcctctcagcctctctttttttgtttttgtttttttgttgttgttgtttttctttctcagacaagatcttactcttttggccaggctggaatacaatggcacaatctcagctcactgtagcctcggcctcccaggctcaagagacccttccgcatcagtccaccaagtagctgggactacaggcatgtgccactgtgcctagctaatttttgtaatatttttgtgttttttgtagagacagggtttcaccatgttgcccaggctggtctctaactctgggctcaagtgatcaacctgctttggcctcccagtgtgctgggattataggcatgagccaccacaccgggcctcagcctctcttaatgagatttttctctttttttttttttttttttttttttgagatggagtctcactctgtcgcccaggctggagtgcagtgatgcgatctcggctcactgcaagctccacctcccgggttcatgccattctcctgcttccgtctcccaagtacctggggctacaggcgcccaccaccacgcccggctagttttttgtatttttagtagagacggggtttcactgtgttagccaggatggtctcggtctcgatctcctgacctcatgatccgcctgcctcggcctcccaaagtgctgggattacaggtgtgagccaccacgcccggccatatcatatattttaaagaaatcttctataaagtagtcctagttgaaagaatggctcgaatttttttttcattgttattataataggattgcttttttttgtttcaagaaatgtaagtggaaaattattggaagtaagaacccgagtgtattgtcttcatgaatagtatttgattgttctaccaaacaaagaaattaataattttaaagaagatacttttaaaatcctctttaaatatgtaagcagcatacttctctgagcttattaaaaatgtaagcactaatttgtacattttgaaggggaacaaagatgttatccaaataatcattttactgtagacacttatgttgtaatattacttagaaaagataattacctcacatcctattaaaactggtttggttttgggttcaggtggtttttattgtggttttttggttttgtatagctgactcttaggaaaatttttggtttcataacaatgttttattccctctcacactttttcctttctgttatgtatgctctctaaagattagaaagaggcttagaatttttttgaccctgctagtctgctttaatataccaaaaataataaataaataaataaatgaggttgggcatggtggctcatgccagtaattctagcacttagggaggctgaggcaggcagattactggagtccaggagctagagaccagcctgggcaacatggtaaaaccccatctctacaaaatgcaggaaaaaaaaattagccgggcttggtggcatgcacctatagtcccaacaacccaggaggctgaggtaggaggatcacttaagccaggggaggtcaaggctgcagtgacctgtggtgacaccactgaactccagtctgggcagcagagtaaggcactatctcaaaaacaaacccataagtgaattaccttttatgatattacaagcatgattgagctacatatacttaaatagtgctttttaaagtaatatcagaaggaaagaagaagaatcatttgttcagtgcagtattttgttcagatacagacctatctctgtttcccatcctgttgagtaacagaatcactttctgattcggaagatcccacatggcccaggaatcactggcctgtcttaaagacccacatgttgttaacataaatttgtgttcaaaagttacttcaggccgggtgcagtggctcatgcctgtaatcccagcactttgggaggccaaggcaggcagatcacttgaggtcatgagtttgagaccagcctggccaatacggtgaaaccctgtcgctactaaaaatacaaaaattagccaggcatggtggctcacacctgcagtcctagctacttgggagggtgaggcaggagaatcactgaagcttgggaggcagaggttgcagtgagccaagattccaccgcttccctccagcctggatgacagagtgagactccgtctcaaaaaaacaaaaaaaaagttacttcaataatgtacttttttttttcaaactacagataatctataaggaattaatcttgaaattaattccaggtttaattgttaatgaaatttcacaagcctaatttaacacttgtctggataactcattttgatactgagtaaatagtcactggtcaaaattcttccaatgatgctattccaataaaattcatttaatgaggttatattttaagtatatttttataggttcccttttttttgaggtctcagcaaaaaaataaagattgatttttggtttatggtatcttcaaccttaagtattgttattttttcttccatcagatgctgtgccacttttcctgaggcttctccattcaccccatcagaatgtctgtgagcaagcagtgtgggcattgggaaatatcataggtttgtataaaacttgtaatactagtctaaaaattgttatcatatactaagtaataaaaatagctactagtaatccaaaagagaaaacagtttgccttcagtactagtttttgtgaaatagcttacagaaatttgaactgtattactgtaaaagcataaagtcatagtaaatagaatttttgttgcttaagataccatttttttggtatatagttagctcttaattatttgaataattatgcaagatgtatacaatttagaccttctgtctcatgctaggatccattttttcttcccctaacccccatgttgatcagtggggtccctttttatttctcagctttctccatcaaagaaagtaacaagaaaaaagacaaaacttaaaccaataatttttctccgtaatgacagttctgagaagagtctaaaatgaaattttttctctcttgcagacttcagtacattagaatttagtaatgtataaaatatagtaatattatttcctgtcaccatgaatcaacaagacataaccatagccttttgacagtctggttaaatatttaacactgtgattactataactttcaggttctctctgataaataattgtaaggaaaataaagacaattctgatatttcaaggatttgtttttttaactagagcctaaactcaaaaattcaaagaactattctccagtaaaggatggaaaaaatctgaattgtattgtgccccagtatagctcagagacctaacagttatgagtgggggctgaggtactgtttgtaggggtattgctaatctagtgaaggagaatgattctaaagattatttttgccaaattctttattcttgcatggaaataatcattgttgctttgatatgccatctctttattgcccttatacagggccaacatgaaagtaaagagtggttatgagtttttaagggagaatttctctgtaaaccattcttgacattgggtttatactattaggaatgctattgtttctatatccagactccctcactcttttgcttttataccaaatgttagatttagagctattatacagcatcttgatctttcatttttttattccagtgacattccgtaattaacatgaatataaagatgcaaaaagaacaaacattttatctccagatattatagtgcaagggaaggtgctttcacttatggtaacatttcaacatggcttcatattagaaactgcagtgatgcttcagatacagaaattaaacttggcagttctctgcagcagtggttctcaaaccttagcatgcaatcaggactacatggggtgcttgttaaaacacagaattccaaacccatagagtttctgcttcaggaggcctgagctagagcccaataatcacattgagaaccactattctagcactggttcacccttttcttctgacatagttttctaagtgtatagagtaatttatagttcataaccttgatgctctgatacgggatcataagtacaaattcaacaaatattttcttgatacatcttttttatcacatgaaagtttgttaaaccaagagtattgttgagagagaagttaaaagcagcagtttaattaagtgagcagcaaaatgctgaagatgggaataatgtgcaaaagaataccttatcactttatgttgcctctcttggctcagagaccttgaatgtgagcctgcttgttattgtctaaaactgaacagtgtatctggataaaatacatgaagcagcatattcccagtgctttgtgttttctgaaaatgcttactgtcagtatgttttattgagtaaattaatcctttttttctacaggtgatgggccccagtgtagagattatgtcataagtcttggagttgtgaaacctttactttccttcataagtccatctattcctataacattcttaagaaatgttacttgggttatggtcaacttatgtcgccacaaagacccaccaccaccaatggaaaccattcaggaggtaaacacttttaaaaaaaaattaaaagagataccattatatatatattttttatttgtgtatgtttttaaatctacatatttctctcctcagattcttccagccctttgtgttttaattcatcacacagatgtaaatgtgagtaaatgtgtcctattatatatttatgtatgtatgtatgtatttctagggcttcccctgtgacataggggagaaatattatactaacacattgtgtcagcatactatcagattttcccatttcaagagttattttatattagattagttattttataatattttaatatttactctatgtttatctatatcacaaaatataataccagttaagaaatcaagcataactgttattttggtgtggacaatattgtatgtatgtgtatatattagtgttataaaaactgacattaaaagtttttaaagttgccagatagtggtgatttctcttactaagatcatgtctttaattgttcttgtgctttttacagaaggtcattttgacagtttggccaatgaaagcacacacaaatagtgctatttttgttttttgaaagatgaaaaaggaaaatgtttgtgcatggatttgtattcatatacacataccaaaccatggacatcaattgccctttaattccatttttattctatttctcagttacagtgactggcagtggcttcatttatcaagataacttgattatccaaacaacaggaaaaaaaaatcagtgcaggcaagattttaaacatagcaaatatattttgcttatttttactaacacagatggcagaggaaaaagcaactcagggagtatgaatgaggtggaaaactgccctgagtgcttgtaaaagccagaccagcctttggtgtgttagagaaaccaggaatataatgggtaagggaaaacacatgaatgaaatgtttagcaacaatcaggaactcatgtggttctttaaaaacagtttggcatggtgaccagtgttggacaagctgcttcatttctttacaatttaaaggcctatgccttttggccagaatttaatttgtatggaacaaattaaaattagaattttactgtatcaaacagtgacataatatataaaattcattagatgaacatgatctctgtggtagagtttttgtttgtttttagccccagatagtttaggatcttaaaaaatgtgtaagtaatttttggttttggctccttaatagccaagttctttgattaaattgtgaatttcaatattttgctttgaaagatttacaagaggccaggtgtggtggcttatgcctattgtcccagcactttaggaggctgaggcaggaggatcacttgagtgcaggagttcgagaccagcctgggcaacatgacgaaaccctgtctctatgaaaaataccaaaaaattagccaggcatagtgatgtgcacctgtagtctcagctactcagtggctgaggcaggaggatctcctgagctggggaggtcaaggctgcagtgaactgtgatcatgtcactgcactgcagcctgagtgacagagcaagaccctgtctcaaaaataaataaataaataaataaataaaacgattggcaagaaagatttaacttcaaagtttatacctctactagaaaacaagacatcttggttgactttatttagagatagattgtgttctttccacctatttactccaatctagatgagactgtgactccattttcttgcctttgatgtatcttgaagaatttctcaagcctgtttacattgttctttttagtaacatgattaacaaataatattgcttactaaataatgtgttagaagtttgatttgaattatgattttgatctgagcatattagtgacatgtcctttaaaaacatgtatctagcttttatatacagttatgagcaagtaacttgaaatttttggcctatgtcaacaaattttagcatatgttaatattccagaaaagaaactcagttacatttgcaaattgaaatttaggttttttcacatatattgataccatttttttatgtgaattcttttttttttctttttgagacagagtctcgcactgtttcccaggctggagtgcagtggcatgatctccactcactgcaacctctgcctcctgggttccagcgattctcctgcctcagcctcccgagtagctgggtttacagatgcccgccaccacgcctggctaatttttttgcattttttagtggagacagggtttcactatgttggccaggctggtcttgaactcttgacctcgtgatccacccaccttggccccccaaagtgctgggattgcaggcgtgagccaccacacccagcctgtgcgaactctcatttgatgtcttctttttacattagaaatatccttagagctttcttgaatttcctaagaaacaatggcaaagcattattttcaccttttaggagtttcggggtgtctttttggttttttttatcttatttttttattttctcttgggtgtcctaagcataacattagtttacagttttacgatttttttaaagtcagggtcataaaaacaagaaaaaataaacaatgccgaattgtttctgtttttcatagagacggggtttcaccgtgttgcccaggctggtctgtaactcctgggctcaagcagtccacctgccttggtctcccaaagtgctggggttacaggcgtgagccactactccctgcctagtttattgttttaaaggttttacacttctccagcttgtcttgacacagagttcatattctggaaaggctttggaagtagttttaggcacaattattattcccatgtctttgtcaataatttgtgtatttatttgcagcagttacagttgtttgtcatactgccctttggtcataacttctaattaggacctaacgtactaggaaagatcaaacacatggcctgttgtacttaaagatgtaatcgttaaaaaaaatggtaggctacttagtagaagttgattacacaggcttttttttttttttcataagtagcagctgtagtgaagtacgtattttttgttttaattacaggtctcacagattgacctatgattattttaatgtcttgatctgcagctgtaggggacttccactatttaagaagttgctggccgggcgcagtggcttacgcctgtaatcccagcactttgggaggccgaggcgggcggatcatgaggtcaggagatcgagaccatcttggctaacacggtgaaaccccgtctctactgaaaaatgccaaaacttagccaggcgttgcggcatgcgcctgtagtcccagctactcgggaggctgaggcaggagaatggcatgaacccgggaggcggagcttgcagtgaaccgagatcgcgctgctgcactccagcctgggcgacagagcgagactccgtctcaaaaaaaaaaaaaagttgtctccagttctgtaaggcaaaacaaactggttggaaaagattaaagtattttatactacaatatgaatacttgggttattggctttaggcatatctacatggtacttacaatactagagaactccttgaatatattcatctagcccagatgttttgaacaactgtgcatgttggatacatgtagtctttccagctttatacatgagccacaatgtttttggacctgttatccctcagcctttgggaaagagaatgtctttttctcctgttttatgagctgtgtagtgtgcgtgtgtatcttagtgaactaagattggatactaatctgggatcagaatcctgaatatggctaaaagatgtacgtcttagtacagacatttatagatgatgatgtttaataccgtagcgatcagattccaatgaattaaactgagagaagaaaagaaggaagaaggtagttgaacaattttagaatggttgtttggtcaagaattactaaaatgagaaaatatttaaaagttgtttgaatttttattttattcattagatactggtagacacagtctgggccctctcttaccttactgatgctggcaatgaacaaatacagatggtaatagactctggaatagttcctcatttggttcctctgctcagccaccaggaagttaaagttcaggtaagtttgttcttagttaaattataagtatttcttaccactaattgctttaagcatggcattcaaagatggacaatttcagtagtttaaagtatattcttagcataacaacaaatctgtgatggaaaggggaaaataaataataagatgccattgtagattactaatttctttttttaagatggggtctcactgtcacccaggctggagtgaggtggcgtgatctcagctcactacaacctccacttcctaggttcaaggaacattctcccacctcagcctcttgagtggttgggatcacaggcacacaccatcatgtgtagctaatttttttctatttttgatacagtcagggttttgccatgttggccaggctgctcttgaactcctggcctcaaatgatccttccaccccagcctcccaaagtgctgagattacaggtgtgaaccaccatgcctggccggattactgatttttaatgtagaccagggaagttcattatagcaacatgcatggcatctgaaacaagtattgacagacacttattttttcctactcctcttctttttgttcttcctctttcacttccctacttctttttttttcttccttgccaaccatccttatttactcacctggcaagtttagttaactcttatcttcattggtgctgaaataagggtactctactgaaatgtgctgtttagggactttctaaattgttgcttttcacttatttaaatttattttttattgtttaaattctttcacataatatttatcccaaagaatttgcatttagaaagagccaaaaacagagtgtgagaagttctcagagatataagcagtagctgttaagctacagttgtaatgggggagacgcagcaagctccctctacctttctgaggtaaatagtatattttaatctgctaatggcttagaatctgtaaagtacaataatcgcataagagaaaccgttagtctgtagcctaagtcattatgcctgaacatcaaaataaactgtgtggagctgtttttaatttctcctgctcaacccctggagatttctgtttcagaaaatatttcttagaaacttgagctttaaaatgctcttcaggtgatactgatacatagtcagattagagaccctgtaccttaaaattaaagcactttaaagaaggaacacttagctaaatacagaaagaattaatataattggctggacatggtggctcacgcctgaaatcccagcactttgggaggccgaggtgggcagatcacaaggtcaggagactgagaccatcctggccaacatggtgaaaccctgtctttactaaaatacaaaaaaaaaaaaaaaaattagccaggcatggtggcatgtgcctgtagacctagctactcgggaggctgaggcaggggaatcacttgaacccaggaggcagaggttgtagtgagccaagattgcgccactactctcctgcctggcaactgagcaagactccatctcaataaaaaaaaaaagaaaaaacaataatttgtcatttaaggctatttatgacttatcttaaatattcttgccatatgtttatccttaagtttgtatttattttgtgtggtacttatgtcttggtacagaattttggtttgtattttgttttttgtttttccagaaataatcttcagttttcataatggacttcattaaggatctgtagggcttggaatttacctttagccagtgctcaaagaaagttgaaattctctactctacctgacaccttatagagattttcttatacttttcaactttcatgccataatttcataaaataaaatagtgtaatggaaccccatgtagcttttttctctgtacctctactcctccaaatttattttgatacaaattccagatatcattttacacagcttgcagctctaaaatttaagcctatttttttttttttttttttttttttgagacggagtctcgctctgtcgcccaggccggactgcggactgcagtggcacaatctcggctcactgcaagctccgcttcccgggttcacgccattctcctgcctcagcctccccagtagctgggactacaggcgcccaccaccgcgcccggctaattttttgtattttttagtagagacggggtttcaccttgttagccaggatggtctcgatctcctgacctcatgatccacccgcctcagcctcccaaagtgctgggattacaggcgtgagccaccgcgcccggccgcctattttttttaacataaccacaataccactagtagactttttaaaaccttaatgttaaatattcagtcagtatctggattttatttactgcttcattattttttcacaattttaccaaatcagtatccagataaagaccacacattgcatctgcttgctatatattttaagcctcttactgtgcaactttcttctcctttcttttatctttcctcttttcaatttatttgttaaagaagctaggctactacaaaacatttttggaaaacattaaagaagacctaaataaatggaaagacattcatgttcatggattgtctaatattgttaggatgaccgtgcttcccaagtttgtctacagattaaacacaatccctattaaaatcccatgtgcttttggtttttggcagaattttacaaacagatcttaaaatccatatggaaatataaggggcctagaaatagccaaatgatcttgaagaagaacaaagtttgaggacttctcattttcaaaacactgcaaagctacagtaaataaaattttgtgatactggcataaatatagacatgcagatcaatgagatagaatcgagttcagaaataaacctatgcattttatgattagttgatttactttttttgtgtgtgtgtgtgagagtcttgctctgttgcccaggctggagtgcaatggcatgatctcggctcattacaacctctgcctcccaggttcaagcagttctcctgcctcagcctcccaagcagctgagattacaggtgcctgctaccatgcccagctgattttttgtatttttagtagagatagggtttcaccgtgttggccaggctggtctcgaactcctgacctcaggtgatccacccgcctcggcctcccaaagtgctgggattgcaggcgtgagccaccgcgcccggccaagttgattttcaataaggaagccaagccaattcattggggaaagaataaccttttcaacagatgggcaagaacgactggatatccacaagtaaaataatgaagttggaccccacttcatactacatgcaaaaactcagaataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcagctactcgggaggctgaggcaggagaatggcgtgaacccgggaggcggagcttgcagtgagccgagatcgcgccactgcactccagcctgggtgacagagcgagactccgtctcaaaaaaaaaaaaaaaactcagaatagatcaaacacctaaatataaaatctataaatttaaacctcttagaagaaaaatacaggcataaatttttatgaccctagattagacagtggtttctaagatgtgacaccacaagcaaccaaagaaaaagaattgataagtcaggcttcacaaaacttacaaacttgtgtgtgcttcaaagaacaccatcaagaaagtgaaaagacaacccatagaatagaagagaataggtattagaaaattatgtattggcaaagggatttacatctaaaatatttaatgtataaagaactgttactactcaaaaatagacaactcagtttttaacttggcaaaatatttgagtaagcaggcttctaaagaagatataacaaatggtcagtaagcacatgaaaagaagctcaacatcattagtcattaaggaaagggaattaaagccacagtgagatactacttcacacccaccaggatggctatagttaggaagacgataacatacttttggtgagggtgtgagaaactggaattcgtatatactgctggtgagaatataaaatggtacagccgctttggaatatagttttggcagtgcctcaaaaagttaaacataaggttacaatatgaactggcaattaattactcttaggtacatacccaagagaaatgaaaatgcatatccacacaaaaatttatacacaagcattcacagcagcgttatttgtaatagccaaaaaatgaaaacaatttgaatgtcagccaatgaatggttaaataaaatatgatacattcacacagtgaaatattatttggtcatgaaaaggaacaaagtattgatgcatgctgtaacacgaacttttaacaacattatgtgaaatgaaagaagctagacaaaaaaggccaaatacattttgattttgttaatatgaagtgcccaagatagccaaaatcttagagacaggcatagtgtcttccagggacctagggatgaaggcagtgtgggagtgatcactaatggatacaggtgttctttttggggtgatcaaagtgttctggaattagatactagtaatagttacacaactctgaatatactaagaactactgaattgtacactttgaaagggtaaattttatgttatatgaattttatttcaattttttaaaaaatttggatcatttgtcatgtagaaaggaaaattagaggagtaaaaagctttacttaacaggaaatgacctcatgcaaccacagaaaaataattgataattcaaattcataccatagtgaaatctcatgttaggcaggtatcttctttccttcagaaaggcactatgttttttgtctttttgtttttgacagggtcttactctgttgtccaggctggagtgcagtggtatgatcacagctcacttcagcctggacctcccaggctcaagcaatcctcccacctcagtctcccaagtagctgggactacaggctcgtgccaccacacccagctaatattttgtagagacagggttttgtcatgttgcccagcctggtgtcaaactccagggcttaagtgttccacccacctcagccttccaaagtgctggaattacaggcgtgagccactgcacctagctgtttttatttttatattttcaacactaaatctaaagttctgtcttttttttttttatggcactatctaaaattatccttcttgtttattgactcctctcttacaataatataagctctgtaagagctggaacatgtgtctatcttcacatctctgttcctacatcagtgcctgatgctaagtgctcaaaaagaataggtttcttggagcagggtgcagtggctcatgcctgtaatcccagtactttgggaagccaaggcaggcagatcacctaaagtcaggggttcgagaccagcctggccaacgtggcaaaaccccatctctcctaaaaaaaaaattacagaattagccaggtatggtggcacgcgcctgtaatcccagctgctcaggaggctgagccaggagaatcgcttgaacctgggaggtagaggttgcagtgagccaggatcgagccactgcacttcagcctgggcgacagagtgagactccgtctcaaaaaagaataggtttgttggaagaaatagtgaatgaatgcatttgtcttttataaggtacctaacatgccttttaataaggagtgtttcagctgggcacaatggctcatgcctataatcccagcacttttggaggctgaggcaggcagatcccttgagcctaggagttcgagaccagcctgggcaacatggtgaaactctgtctctacaaaaaatacaaaaattagccggacagggtcgtgcactgctatagtcccagatactctggaggctggggtgggaggatcacttgagcctgagaggcagaggttacagtgagctgagatcgcaccactgcactctaccctgggcgacagagcaagaccttgtctcaaaaaaaaaaaaaaggatttcacatagaatgtcatctcattgtgcatttcagactgctgcacttagagctgtgggcaacattgttactggaactgatgagcaaacacaagtagttttgaactgtgatgctctttcacacttcccagcactcctgacacatcccaaagagaaaattaataaagtaagtactattaaatactacttaatagatagcacttaaaatgttaacagtttctatttgtaaaattagagtcttagaaatgtctgtaatattgattcttaatacaaactgtcatttagacatcaagagaaaataaaaattttactctccataacaagcattaataattttttcatacataaaaccagttatgaaaagtgcaattttggctctcttggaaatgatgaaatagagataattgggtgttgaatgttgtatgactggaaatttttaatatgtatattatgtaattcttataagtttagtgttttataggtacttaatagagagtgtgtatgcatgtgtgtgtgcttgtggtggctatggaaagggggcactgactggtgatgctgatattggagtgcatctgaggctgttgtagaaataacatgggttgttgattacaacattgccaatgattataacccaagaacagctcacctaactagcctggcaccctaaaatctctaacaggttcattaaaatggtcctgtgatctgatccaaaagagcctagtatacattagctaatactaatattttttagagtaaaacttattagttatctatgattataacgcgtaaggccaccattattttgtcaaaagtagcaccaactgtgatgtaaagggtaacataaaaagattaagataggccaataaaacaatcaaatatctggttccacttttccttgagagaaattatgcagtgaatgactattacaaataagtatactaaaacaatgcactttgttttttatgtctccattgttgtggataattgatatttatctactttggctaagattcttcatcagaatagaatagagaataaagcacattatgtgagggaagggcactgaatcttatttacagctgttttaggatttgtatttgtattatactcattattcatatttgctcattcattatttcatatttgctcattcaaatttgttcagccaagcttcttttgagccacactgtttgggagcattgttttcaataattcttccgaagggttagttcattgtgatttgaattaggtccattagctgtttgtccaaagaaaatatggaaaggggtgtaaaggaattgagattcctgagatttttattatggagctcatttcgtagtaaaatcattgggacagtgtagtgaatgcttttttacttagttcagatgcagattttattttttaatgagaaatattcaaatgctcttgttctacaggaagcagtgtggttcctctccaacatcactgcaggaaatcagcagcaggtacaggcagtaattgatgccaatcttgtaccaatgataatacaccttttggataaggtaagaaaatcatgttatatgtatcatttatctgatgtaaggggaaggggatttaaatctgagacattatgtgaatttatactttctgcttaattagaagccatacagtggcataaatatagtaaagtaatattaacattacgacttttgaacctagccatttttatatacaagaaactttttggggggtggggggcaaatcctagccctttctgtgtatcattcttttaccaaaattgccattatcctaggccatactaaactttcatatcgttactgttgataataaatgcttacatagtattctaagcactttacatacattacctcattgaatgacattaagcctataagattagggattattcccacttgatagatgaagaaaccctggtatagacaaataaattgtccaaaatcaaatagcaaataagtatgctattgtatgccatatcatctctcatgctcatattagcatttgggagaaacagtttatcgcaattacagcatgaggctgggtgcagtggctcacacctataatcccagcagtctgggaggccaaagcaggaggatcacttgagcccaggagttcaagaccagcctgggcaacatagggggactccatctctacaaaaactttttttaaaaaagaaattagtttggtgtggtagcatgcgcctgtggttctagctacttgggaagctacggtgggaggatcatttgaatccgggaggttgaggctgtggtgagccatggtcatgccattgcattccagcctgagtgacagagcaagaccctgtctcaaaaaaaaaaaaaaaaaaaaaaaaccacaaagtagaagaaacaatcacagcatgagggttctgaacactgatctgtaattaaagagaagataaatctgtttctctgtgtttcctgtaaatcgagttcagttttttaggcaagaatatgtcatgcacaactctatttcctaatgattcacatgaggagacacagtctgtcttacatgtagtgatattaagattgttgagtgatctgaggtgttacagcctattccagctgatggttataaagttatccattaatctttcacctatggtttttaggtagccattgatgatccttgttaggatcccttgttttactaggagttgcaaaatggtgactttctaattccgtcattctttgtgtattggccatgattctttagtaaagaacttgtcttgttttttgttttgttgtttttttttagacggtctcgctgtcacccaggctagagtgcagtgacacgatatcagctcactgcaatctctacctcccgggtttaggcgattcttgcgcctcagcctcccaagtagctgggactataggcgcacgccactacacccagctaatttttgtatttttagtagagatgcggtttcaccatgttggccaggctggtctccaactccccacctcaagtgatcaggtgtgagccatccatgcccggccaagagcatttctttatcagctattgtttattaatactttgaaatacagttcatttaggataggcaagataaatgtttgattctttgtccttatcagtcattttttagaatgactcgttccctaataaccttgaaagcagaccagagtagatttttttttagtgtcatttggaaattatgaatttttaaaatatattttgcaagttttaataccttttagttgttactctttttgatactctgtttgttcctgaccaacaggaacctcttagaattggtgacctgtatcttttatgttatcactagtttttgagagctacaccttttggatatgacatgattcccaggcctatcttacatgttttctgatctagaactggaattaactatttttctatggtatcttgattttgttttgtagagaatggtgtttaaggatcatatttcagctataaaggtgatcattgttataatgttgtcattttttctaggcctgaatcaacaaaataaatgataggcattgtagaaagtgaaagatgatgagttcaggaacatgagagttcataaaaaatgaatcatgaatgaaagggagctattaaatattattggatatttaagataacagggtttttaatttttattcctatgattttatatttacatctcttttatgctgaaaatcttcctaaaaacattagcataattacttatttttcttacattttggtatgtatagatctgtggatacatgtcaatatacattatttttaagtacatcattgatgatatatatcctaaagaccataaaaaactcctaattttcagcatgagacaaaagagatgcaaatatatttatatatatatatataaaaataacaaagccgtattgcccctgacaacatgactactgaatgtacttttaagatttctttgacatttgtttgcccttagaatatatttcatcagtaatgtacttaaaaaaatgtcagtcccatagcactatatagagagcttctttattccttgtttttttttcttattccttgtttttcttattcctttcatagctacatagtactgcattgtacggatgcactataatgtatgaagtcaatctattaatgatgatatttgagatgtctccagtgtttgttgttaaatagtactttaaagaatagtggccgggtgcagtggctcacgcctgtaatcccagcactttgggaggctgaggcgggcagatcatgaagtcaggagatcgagaccatcctggctaacacagcaaaaccccatctctactaaaaatacaaaaaattagccaggcatggtggtgggcgcctgtagtcccagctactcgagaggctgaggtaggagaatggtgtgaacccaggaggcagagcttgcagtgagccaagattgcgccactgcactccagcctgggtgacagagcgagactccatctcaaaaaataaataaataaataaaagaatagcttgtggctgggcacagtggctcacacgtgtaatcccagcacttgggaggctgaggcgggcagatcacttgaggtcaggagttcaagaccagcctggccaacatggggaaaccgtgtctctaccaaaaaaaatacaaaaactagccaggcgtggtggtgcattcctgtagtcccagctactcaggaggctgaggtgggagaataacttgaacccaggaggtggaggttgcagtgagccgagattgcgccactgcactccagcctaggcaacagcgaggtcctctcaaaaaaaaaagaatagcttgtaagtttttttttgatgtttttgcccgattatatttgggattactagatctacagataaacatatatgtaaattttgctattatagggctaattcccctataagaattatgccattttatactaccagcctcacacacaaatatttagattttcttattctgataaatatgaaaggagatatggatattttaatttgcatttcttttatttatgtggttttttaatacatcataagcattttttcaggttgccacttgtcttaatatttaatagttgcttattcagtagatttaccataattagacaattatgcttattgagaattttagttgtttttactttttggctattatggtgctgtgataaccatatatagaaagatattattactctgctttatgttattttcttggtaaattctcaaaaatgagattatgaagtttatgtatatgaattttttaatgacttttaaatatttcttcgcttcatatttgaaaaggcaatgtataacatctttatcatagtttcattaatggtgggtatcatttttgtgtgtaaaagctttgtgtgtaaaagaatatgttcgtttacgtgactttgtagtgaaattgtagatttttaaattttttctttactatttttatttcattttatcatcaacttcatttaatctgataatattagataataatatcaactcagtttgtttccaggagatttcacagaaaggtgtctccatgtatttagggtagattgggaatagttcaaagacctgtcttaataagaaaaaatgatatatacagaaagactaaaaggagaccttgggaaataagcagttgaaaaatcatcacagcaaacattttttccagtttactctatgtggcaatttttatagcctttgttttgcctttttacagggggattttggcactcaaaaagaagctgcttgggccataagtaacttaacaattagtggaaggaaagatcaagtaagttgagctttttaaaatttatttctcaaaactggtaaaataaaagtacaggtaatattgatttagatttgagtaagttataatttaaaataatagcaacaccctgggaggccaaggctggaggatcacccgaggccagggttttgtgactggcctgggcaacacagtgagaccacatctctattaaaaaaataaaataagagcaagataacaggtactaacttttatataacaggtatataactttctttgtcacatagaagtatcaccttgacttcctttcgtcatacttcatagaagtgttctttttcccaatttattggcctacaagaattttttaatccatggtaaaattgaggcccctatagtcaggagttttttgttttgttttgtttttttaacagtattaggaatgaacagacttcttaagttaatatggaagaaactgcatcacacattctcctaacaaatgaacaacaacaacaaaaagtaaaaagacagcaacaataacaaattcatcagcagcaaaccaaacaaggaattaaaagctcaaccagatggctaggacttaggaactagggtgaggaatgtaagatgcctaggaaagaggcacccactctcaggtcgtgcgggtgacaaagcttaacattgtgccaactggcaaaggaaaaacagttttaaagaggttagatctgtttcacagagtaggtaaaaagaacaaatttagagctgaatagcaataaattgataactgtaacaaaaaggctgcagactggtggttttcagtgaattcacataaatacagagcagaacaggaatattaatataatgcatggaaattataactaatgaaatactgaaatcattggaaaatattgtgaaatcaatagaatagtgaattgagaggtagccaggcacatgtgagccactggatgctgtcacattgagccattgtagttttttgaaactagtatccaggcgggatgcagtggctcatgcatgtaatcctagcattttgtggggccaaggcaggaggatctcttgggttcaggagttcaagaccagcctgggcaacatagtgagacccccgtctctatatattaaataaataaataaatcctgcgcaacatagtgagaccccatctctctatatttaattaattaattaattaaattaaaaatagcatacagcctccattaacagcctccttaactgatttcataatttcttactcttaaagggaaaaatctttgaaggaagtatttcttatggcaaagaaatgtttaatatgaagttgagtgattcctttattttaactttacgttgtttttttctaagttcgggaaaaaggaaactaaatttaaaagaaaaggaggttagattaataatgtgggcacacttaacatgagagagatgaggtcatatttctatactcgaaatttcaaaatcagaattattccagtgagataacatggcacacaaagtttacctatattgcattattttatgttgtttttattcttcaggtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggaggtaagtttattataagctcttattccacatcttaatgttctctttgtaactacctttatttgccgactaatatagcacatctatatttttctgtcttagatattcaagtaacagaataaagtaaatattgtattctatatgtgcagtcctgctcagcctcttgcatatgcttaggtaactgaattgctgccatatattgaacaggcactgtgataagttactgggaagacagtggtaaacaagacacagtccttgccctcaaggcatgtagtctagtcttgataaatatgaactgatttaatgtgctaattaccctaatagaaatgtacaacaaaatgggatgcctaatccattctggaagaagcaggaagtgcacctgagctggattttgagagatgaataaggattaataaggtaaaaagggatgaaaggtgttccaggcagagataacaccatgagcaaagtctgaggtcagaaatagcattcagcaaattataagtagttcagtgttgctgaatcacacagtatggggtagaaactatgaagagacaaagctggagaagtaaccagcctcctatgaaggctttttttttttttttttttttttgagacagtgtcttgctctgttgcccaggctggagtgcaatggcacaatctcggctcactgcaacctctgtctcccaggttcaagcgattcttctgcctcagcctcctgagtagctgggattacaggcgcctgccaccacgcccagctaattttttgtatatttagtagagacggggtttcatcatgttggtcaggctgctgttgaactcctgacctcaggtgatccactccccttggcctcccagagtgttgagattacaggtgtgagcaactgcgcccgacctcctgtgaatcttaacaagctttatggcacagtagatgttttattctttagggcaatagtttcgaaacatggccatgtaccagagcctcctggaatgtaaacaatacatattagctttcaagtcttagagttaatatatagacagaacatgaaaatttcaaatgtggctgtgtaacacagtgtgttatcaatctggataagcataaatataaaggtatttctgacagaagttgaaaagtgaatgaaaagagaggtaactgcaaaagtaggagaacccataacttcaactaaatgggaatggtgagcggcttcaaaattaatgtagtaagaaatagatatatttaaagttactaaagtgactcatagagcaacaacaataaaaaaatctataactgtcgagttaggaacaagagatggggaatagtgttacagaactaattagggattaagtaacaaaaaataacaataggcatacttaattatttttactacttgatttttttaacttgtaaacattttaattactaaaatatctttatacattcaagtaaaaatgtaagttcttgaacattgcctacctcactggaggtaagacccaggaatccccagtggattgtgccataggagtggcaggccattggtgattcatctaggggatggggtgcattcaggtggaacatggatatctggggaatgaagcctttggagaaaggaggcaggaagagaccagttaagaaagtatttatggccgggcacagtggctcacacctgtaatcccagcactttgggaggcccgaggcgggcagatcacctgaggccagaagttcaagaccagcctggtcagcatgatgaaaccccgtctctactaaaaatatgaaacattagctgggtgtggtagcgcacacctgtaatcctagctgcttgggaggctgaggcacgagaatcatttgaacccaggaggcagaggctgcagtgagccaagatcacgccactgcactccagcctgggcaacagagtgagactctgtctcaaaaaaaataaaataaaataaagtatatagtggccaagccacaataaatgaaggcagtaataatagagacaaaggggagatgaggagatttaaagtccagtggatggactttcaagtttttgaggtttgattgtgggatattgagggaaaggggaacttgggctttctcttaaatttcaagctattgttgattatcaccaaataagaatacaactgtaggatgaaccgtttaaatgaggaaggcaaataacaaattgtgttttggacagtttgagttttaggtagctatgaaatttcctggtagaattacacaagcattttagttttatgcatgtgaagctcagaaaagaaatgaagctatagatttgcaagtcctcagcctatgtgtagtagccagattttttaatgggaagatcaccagaatgagtgtgtaggtgagaagtgagcctaagataactttctccatttaagaaatggatagaggaagtacactcatgaaggggcaatttcacttttttcaaagactttaaaattatttttcctctaaagtaaaacaggatccaatttgtgtatcaacaagttaagtatatactttttaatgtttctgcctataatttaaactcattaatgtttacagggaaaattctcttttcccctgaaatactgtgttagatcttcatcattttccagtaaacttaacaggtatcttaagcatcatatttattaatcaccagtattttaaatttattttcatacgtgctcactagaaaaacttggcaggtgctggaaagtaggaagattccgctttttacttaaatggaattttacatgttattgctggttataaacattggttatgtattctgatgaataggcagatgtctcattacttatttatacacttatttgtacatttacaagcagttagacactcaggttgttgattttaagataaatatgctgtatctttgtgcataaaatttttttatatttaagattcacctttaaattcccaaaaattataattcaaaaaatttgcgattcagaaattggattatgtgttccaaagattattctaacttgtcactgctctttaaatattactattgtttcacattgcaaaatttcttgcagggctggagaaaattgaacaacttcaaaatcatgaaaatgaagacatctacaaattggcctatgagatcattgatcagttcttctcttcagatgatgtatttaataattttgtagttttcttaattttatatataaacatagatctggataaagtaatatatatagtaagctgggggacatacatgtgtatttgtttggaatggaattaaaatagatgtatgacagtaatgtcacctgctttgaaaacaaatatttcaatattttaagatcccttcagggcatattagctctaatggcaagaaataaggacttttttgaccaaacgagatgagtcagactttattttcacttggtgtctttatagttctcattttttaaaattgttaatagcataccatatttataaacaaaacagtgatactagtatatcctgtaataagttctttatgacagtagttaatccacacttgatgggttgtcactgtttttatttcatggccaaaaacaaatacgaaaataaataagatggaaataaaaaggtaaggcactatataatgtaaggtatagtatacaaaaatatcttcagattgttagtaatagtagtggaaattaaagtattaacttatttttagtatttcctctttggaaaagtaaatctaaaattaaaccaattgctccttagaaaattttatagtggttcagtgcagccaccagaggatttctttaatgatttctcagcttttcaaagaataagtcttttactgcatgcctttccatattatcaaaaagaatagaatgttattaaacattttgttaagtatgtatagtttgaacattaacttgacaaggacaatattagaaaagaaaattatagactatttacttacagttgtttaagcttagtcctatttagaatataatgccagttaaataaaccagaaataaaattaagaaaagttttttttctttctttctttttttaaagacggggcccaggctggagtgcattggcgcagtcacagctcactgcaacctccccctccctggctcaggtgatcctcccacctcagcctcccaaatagctgggattacaagtgcttgccactatgcccggataactttttaagtcttttgtagagacaaggtctccctatgttgccctggctgagcttgaactcctggactcaaacaattctcccatcttggcctcccaaagtgctgggattacaggcatgagccaccacgcccagcctggcatattcttttaagagtaactttgatcgtatgtcttgaagttggatttttgaaaatcataatttgcaatttggtgactaattgtaatagcctcataatttctaatacctcaacatgtagttttcgttcttgacttagattgtgaaaagaataattcagatgatatacatagttataggaagtacactacaggtttgtaatattgtggaatttccaaaaggagcctttagatgcaaagcatatagaataatgtatataataataataataaccattattagcagaactattataggtggagtatcccttacctgaaatgcatgggaccagaacagttttggattttggatttttttgaattttagaatatttgaattatttctaccacttgagcatctgaaattcaaaatgttccaatgagcatttcctttgagcatcatattggtgcccagaaagtttcagattttggaatattttttgttttgtactttcagattagggatactcaatctgtattttactattttaagcccaaataccatttgtctctaattgctattgaaagatataccaaagattcactttccaaaagtggtggcattagatttttttttaatgtgattgtctttatgtacttgcccggggtttttttgttttgtgatttgttttgttttgttttgttttgtttgagacagagttttgctctgtcacccaggctggagtacagtggcacaatcttggctcactgcaacctctgcctcccaggttcaaggaattctccaccctcaacctcccaagtagctgggattataggcgcatgccaccatgcccagctaatttttgtatttttagtagagatggggtttcgccacgttggccaggctggtcttgaactcctgacctcaggtgatccacccgtctcagcctcccaaagtgctgggattacaggcatgagccaccgcgcctagctgtacttgcccaggtttaagggaaattgtaatgagaccaaattttgcatcctctctttgagacttagggccatcattactgttccttcattcttttggaaaatgcccgtcttacatattctcttttttctcattttggcatcccttaagaaaaagtcttgggtaggcactgtggctcacacctgtaatctcaatactttgggaggtcaagacaggcagattgcttgagcttaggagtttgagaccagcctgggcagtatggtgaaactccgtctctacaaaaaatacaaaaattagccaggcgtggtggtgcacacctgtagtcccagctactcgggaggctgaggtgggaggatcacttgagcccaagaggttgaggctgcaatgagctatgtttgtgctactcatctccagcctgggtgacagagtgagaccccatctcaaaaaagaaagaaagaaaaaaaaaaccttctataaactgtttcaattttctaaaggatggtaagacagtgttggcattcatcatctctccagacctttttttaagggtaatgggattagtactataatactgtttatatatattttaaaactaattatcacattctttttcttttttttcacctagattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaa

SEQ ID NO: 37292 - DNA, 30224 bp, Homo sapiens
ggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccggaaacccgccagcttggacatctggcactgcgagtccacgctcagcagcggtgagggcctggcgcgccgcgacccctgcctcccgccccggactgccccgcgccccactgccaggacagtcaccgcctgtccccacgtccccgcatcctctgccctggcccgtcccaccccgtccaggcccttctcggatcctggggctcccgccacctccctggcatccacccctcttccctccccatccctggtcgccaaacctaaagcgacagcccacgccctctcccttccccgtggccattcctcctgttctggagtaacacgtacgctattttgggtatttgttatcatttgaggcgagagccatgtggctgtgtaaaaaaatgcgacgccttccacacccccgttaaaaaagaagcaggcaaaaacgccccaactccaccgagatgctgcgggggttcgctgttcggtcttccccactctttttccttcctctctcgaggacgaatttgcctagtgttcacatttctgccggttccactccaccttatctgcgttttcaccaatgtatttcggtttggattttatttccttacgtttttgatggatatgaagagttgagagagggacaggcttgttttcctttccttttttggtgacgccgccgttgattgtgagttgcctttctttctctgccactctaagtaactcttctctcctccagacctttcttttctccatgagctactcacagatgcctagaaagttgtgctttattccgccagcgctgaaagctgcaaatggataagatgggggtggggagtggagaataaggtagctactgaggctaccagtcccagggggctttactgctttccgccctccctgaccctccagttgccttccccggcgccccagttatgcccttagcaaaaatcagtcaacttatgatttctcgctacaaaccccttcctttctaattttgattcttcaactgctggtgtcagcgaagagaaagggaaataaagagagaggacctgccggcgattttctttctttctctctctttctctctctctctctcacacacacatacacagactcacacacacacacatagacacctgagaaactcattacattccttccagtttcatgtcttctctgggactatttataaagctttcctggaaacgtttcaagttgtaacaaagttgaaatagcacaaaaagccacaaaaatctgattttcttttgtctttggtttcctgttataacacaggaaaatttgaccaagtttcttctgtaaatttaattttgtgtttaaaaaaggctttttctttgatactacctcaaaattcccattgaagggtttcctctttgttggttaattcactgtggagggaactggttggcagcaggaggtcaacatttaggtccttcaattctttcagggttggcagtttacaactaaagataaaataaatcggcagaatttctttcttcggtaaccaggggatccaaataaactttggcgaaaatatctcctttcccctcttcaataataaaatttatgtaggaatgacagctactgcacgactccttggcaacgtgaatgttttgcccctttctctctgtctcctgaaataatagacccctgattgcataaagacttttcagataggttagagaaaccagtttcaactcacatttgcttttcaagccagtacccttttttcttggccaggaatgtagggaatggggagaagccagctcgagtttgcagagcaacatacagtgtttgctaaccttttcttaattgcctccatacccatttatctcagcttttttcctctctagtcaaggaaatatggagacgcaagcctaatgcaaatatagcggtaatagcactctgcaaagtaaaaatcaaaggcaggcccagtttgggatttttccctgtttattctacccccttgctgaaagtcatagcccagcgtatatttctatttggatttctgaaaatcagctttcatcttatcttgccttaaaaaaatagttttcagcccagataaagtagaattcataagcaaatgggtaaaaagtagagatgattttgttagaggttttctggaacaagttcttgactttgtgtatatataatagcagttcattttttgctctccacggtgatggtgggacacagggcgggggtggaggaaaggaaacaagatatggaaaattgctctgtgtccccactttacaaaatgtactttcttatgttatgtgaatttgaagcttctgtccgccagtgttttgaaaggaaggggaatgcccgaatcaaaaccagcagtgcttttcttgtctgttccaaagggcaagcagcttttttcgtctgtttgctgtgtggagtagcagaaaacagggagggaaatgtcttctctgaagattttgagagatccacatctttgtctttcaaaataaattaccttgggaggaaccaccaaggacacttttactgaaggcccttcaccaggatctttaaggcttaattaaaaatgtttgtcttaattagaattaaaactgctgtgaagaggcaggcctgtatttactgaaggagcatttcaggaatgtttctactcacaatagtatgccctacttagacccagtttctactgaaactttcccctaagccattatttttaaacttgcattttaattttggtaccaaatgtgcatcatttgctgtttataacctgttttatgattttaagcaaaagtagaaccatgcctcttgtgttctggtgtattgaaggttgcgtcagctcttctagtacgaaccactaatccggttgtcagtcagccgtaatgcttttctctggtgttccaattcaatgtatggaggacagttgaggcactcatcttaagttctaagtgttccagaaagacatatgagaaagcggctaattgactgtgattaatggtggaaagagaaaaaaaaaataaagtgtgcttgttaggaagtttagaatacgcagtactcacatggctgccggccacagaattctttctaagggtagttttccccagtactgttttggggaaccttttaataaaccttaaatcttacacaaattatagtaatattttagacttctgcttagtcacatttagtttgctaactttatttctaggatatagttgctaggatttcacagcaattacaagaatccttagtgtaaataggattggcacaagtgtatacagaatgctgatgccctaaatttgatatcaaatgtgctctataacctctaaggagactttacatttcttctttaaaatgtataaatacatagctatttcatgtaaagcagattgctttttggtgtctgtgtaatttgttgactaaggagaaagcaaggacatacagatggccaaatgaacacttttactaacagtaatttagggatataacaaattcatttttcctttttttatcccaaaatacttgatcaaatagtaccttttttcaagggatattgttaacatcattcacatactatcctaaaaatagctgcatttgtaacgtgagtcattggtagttttgaaatggcagtataccatatgctaataacaggtgaatattatcatttctaattgacaagaaattctttttagagtgctttatatgtagatctttttttaactttagtataaaaagctactttaaaaggaatttataagaaagcctatcttaggtgttaaagataaatggaactgcctaaccacctgcacgtcttagcaaatctgagatatagtgattctgagttcaaacatgtttcatctgttcatattttgcatttattccttaattcgaaaacacagtttcattaggaaacctcacaatgtgatttgctccggggaaggttcagcttgttgcttgaaatgtgttgatattgatgcatttttacaaatagctccgcaagcctggaagtcactattgttatacccacttctggcttccttgaaaagaacataagaagaataaatgcagttttgtttaacctagacatcatagacgggtggacagttaagagtaccagagagcaccaaaactttctccactgataagccagagaaaaccaagtataacttatttcaagatcttcctgatgactttctcttaatgtcttttagattttcaggttccttagatttacttttacaaaggacattttaatgtgtgaacagatataatttctcttttgctcacattcatagaaggattataattcccagggagccacttagatcagtcttggcagctaagggatttgatgggtgtgggaaaagcctggcctttcgtaaaacatttcaaaacaaaacaaaaacaaacaaaagaatatctcaagcaatagattttacttgctgtcgggaatacatttcaagaaatttcctgcaagtttttgtttaatagtaagaccacttgcagagaccatagatatagtcagtgctactagacatgctagtgaaaggaatatagatgcttcaaaatgtgtctctggaatacctaacctaaataccacagcagggagctctctgaaccacttctggttctgagggctaccccaaaataactaaccgaataaataaataaataccacaacaaacttccatgtgagctatgctaaattgtaatgtaattctgtatcagagtagagtagtatgttggagaataaatgagacattggattctaactgacctgaacttggccacttaccaatcatgtgacctcatacaacttaatgtcctcaaatggtttatcataaagattaaatatatgaaagtgcctgtttgttagtgttatgtttcttcctggttacgtattcagaaaatcccagtgatacttttttcaataattgaagatttttcccctttaagtagtaaaatctctgcattgcataatgaattgcataatgaagtactttgtcaatttcaaatttaaattttgatatgcattacctaacatttaacaatgctcttggtagatcatgatcacaaaactattatccttttattcagtcctattacaagccagacacctcagttattcccaatgtcacaataaacttgcaaggtagctaaagttatccctatatattattgaggaaactttggatttttgttaagattaccaaggtctcaattaactagtggtaaagatggattcttaccaagagtattccagttgctaatgctgggaaactaaccacaacaaaagttagtcgtgtaaaataaccattttattatactcatgaattctgtgggtcaggaattcagataggacataatgaggatggatgtctggagcccttgtggaagataacttgaatggctaggaaccagaacgtctggaactgtagggtcattttccaaatgatttcgctcacaggtttggcaccttggtggggaaggctgtgagatactgggcaaagctgtgactctccctggaatgcctacaggtggcctttctagcattgtggtcttaggatattggaattcttacaaattgagtgggtcccgcaggacaagagtcataagagccagaatctctctgaactaggctgagaaatcacacatgtcttctaccacattcagttggttacaaaggagccatatggccagcttggatttaagggaaggagaattgaataccaccttttgatggagcagtggcaagttcacattgtagaagagaatgtgggataggagttgctgttgggccgtgtttggagcacacagtctgacactgagtctaactgcaaatctgcattctttattgcctttgaagaacaacaacaacaacaacaaacggccaaccagtttgtctttgctttgtagcttctgtacttaagaactttgaattgattatataaataatgtctgactgggacaaaaccttccctcagccagcatatggctttaatgactggttacttgtactttggatatgagatggaatgaactcgagaacctaacttttccacaaacagagagatacatgtaaaaccttccaaaatctttggtttagtctcaaacaaccaaggctcaaactgattatgaatctggaatgtaatttgctactttatgttgtatgataaaattttattctttttttagaaagttatgaatgcatctgatgatacgcttgctacatgaacactaaaacattaaaattccagacaggagccaagttttatagtgctagagaagtgttggagttagagttattttttgtttgtttccttttcctttgttttaataacatagctcttctcttaactactgcccatgtattgaatctcagagttgtaacgtgtttaataaaatagacaagatttttaacataatccagtctaatcaaatttattacatgattaaggaaaatgaagaaggatacaatgttaaacactcaatagagagggtacattttgccatagtatttttggagggttggtttttaaaatgttctgtaatattgtagataactgtcacttggtgtttgaagtattgttgaatgatgtcatgtatggaagcttggatgaagaggtgaaggactgcatgtgaaatagctgcccactttttgtaagattatttatcatccatgatttgatttcacatagaattaaagtctgaaaatagaattatatgtgttgataagtacatttcagatgtttattaccatcaaatttacattttaaccatgactagtgcttaaaaataaacacttctactttaagtttctccatgatggggtacgttaaaataatggcttgggggccaggcgtggtggctcacgcctgtaatctcagcactttaggaggccgaggtgggtgaatcatgaggtcaggagttcgaggacagcctgaccaacatggtgaaaccctgtctctactaaaaatacaaaaaattggctggacgtggttgcgggctcctgtagtcccagctactcgggaggctgaggcaggagaatcgcttgaacccgggaggcagaggttgcagtgagccgagatcgtgccactgcactccagcctgggcagcagggcaagactccgtatcaaaataaatttgaaaaagcttaattttttttttaacttttattttaggttcggggtacatgtgcatgtttattatataggtaaactcatgtcaccggggtttcttctacagattatttcatcacacaggtattaagcctagtacccaatagttattatttttcctgatcctctccctcctcccaccctcaaccctcaagtagaccccagtgtctgttattcccttctttgtgttcacgagttctcatgatttagctcccacttataagtgagaacatgctgtatttggttttctgttcctgcgttagtgtgctaaggataatagcctccagctccttccatgttcccacaatatgcatgacctcggttttttttctggctgcatagtattccatggtgtatatgcgctacactttcttcatcccatctgtcatcgatggacatttaaattgattccaagtctgctattgtgagttgtgctgcaaagaacattctcctgcatgtgtctttatggtagaacaatttctgttcttttggtatatacctagtaatgggattgctgggttgaatggtagttctttttttaggtctttgagaaatcaccatactgtactgctttccacaatggttaaactaatatacactcccaataactgtgtataagtgttcccttttctccaaaaccttaccagcatctgttattttttgactttttaatagaagccattctgactggtgtgagatggtatctcattgtggttttgatttgaatttctctaatgatcagtgatattgagctttttatgcatatgcttgttggacacatgtatgtcttcttttgaaaagcgtctgttcatgtcatttgcccgttcttaatggggttgtttatttttctcttgtaaattcatttaagttctttatggatgctggctattagatctttgtcagatgaatagcttgcaaatattttgtctcattctgtaggttgtgtactctgttgatagtttcatttgctgtgcagaagctcttaactttaatttatccaatttttcaattattgattttgttgcaattgcttttggtgactttgttatgaaatctttgcccgttcctatgtccaggatggtattgcctaccttgtcttatagggttgacaacgtagtttatagtttatggttttgggttttacatttaaatctttaacccaccttgaattgattttgtatgtagtgtaagaaaggggtcaatcttctgtatatgcctaaccagttatcccagcatcatttgttgaacagggagtcttttctccattgcttgtttttctcaattttgtcaaagatcacatggttataagtgtgcagccttatttctgggctctctattctgttccattggtctatatgcctgtttttgtactactagtaccatgctcttttagttactgtagccctgttgtatagtttgaagtcaggtaatgtgatgcgaccaactttgttctttttgtttaggattgcctttgctattcgggctctttttttggttccatatgaatttgaaaataggttttctagttctgtgaagaatgccagataggaatagcattgaatctgtaaattcctttgggcagtatggccatgttaatgctattgattcttcctatccatgagcatggaatgttttcccatttgtttatgtcttctgtgctttctttgagcagtgttttataattatccctgtagatctttctcctccctggttggctgcattcctagatattttattttttttgtgtggcaattgcaaatgggattgccttcctgatttggctctcagcttggctaacaatagcttaattttaagttgaaaaagaatttccaaattttgtagaagtcaaccatgtatgtttcttaaattgattaaatgaatattaattttcattcaacaacttaattgcattctggctttattaaaagtatgtattaatttatccaaaaagattgaatgttctttcagcagaatttcaacctcacacattaaaggcactgacatttcaattttactaatcttttcaaactattggttcacctcccttgaaaattagacaaggacacctttccttaatgtttttactcctaagtttgtgtgtgatttgggtacacttgtagatcatcaattttctattctaatcatggacactgaagactctcacttaaaaaatgtacaacgaaacatccatggtcttccaaagaagtgagaaaaaatatctataacacctttgtctctatcagcttgttgactgttatgaggtttaaaatgatattttaatgagccatgtttcaagagatcacatatttatactttctgttcaaaatttctgtttattaggcaaaaccatgttaaaaaaatagaagtcgagacccctgaattacttattctctgtacataaaaagggacagacacaaaagaactaaaattttcatcaaagaagattttattgccatcatgtttaaggtccctaaaccaaatattcaccagaatgctgtcatgatgctctgtgaatgaagcctagaatctattcttagctcctctaggtaacttaaaggggggtacattcgaatgcttccctctattttcccatcttctcacatatactcaatgagttaacttcattgaaacgtagtcattggttttctagcagagggtagacattattctgatacaaagtcagccagttagtctgtgttccaggcatcgtggaaggtagtgagaataaaatgatgggtgaaacaaatggtgtcttttaaacaaattattaataattaaataaatgtgcaaagtgctgtgaaggagaaaacaaaggttctacttctgcagcggggcattaagaaggagctggtgggagtactagctttgccaattttattcctccatatttactaaaggggtatcttaatactatcgtgggtggctgtctggctttcttcattctactctttgattattcttagctcccctaaacccattacagtaactttagttgcttagaggaagtttcacccactcctaatcctggagtagtaggttttctttgtgcttttcaaaataatcaagttttccaagttgtaacctaattaggtttttattcaaagagtgaaaaaagaacaatgttcaaaataccaaagtcatcacaactttgtagaaataccatgattagaaattattattgaaaaataccagtacttgttaggtaacactagttaccatcaaatgcttatgaaaactttcaaagatggtgcatggtaagaaacagcagtcattaggggtgatagtgtctttctttttgtccaaatactggaacttgccttaacagcaaggctctttgctaaatactgtattcaagtggttttatttgaggaaaaaacaccatatgttattgtgtttagattattaattacatttccactgaattatctaagacagaattctgtgaagcagctaaaatgttccattatttgttgaaaataaaaagtatgtgtgtttttttttctaacatcaacataaaacaactccaagatcttgaatgaaattgacattgttaaacactagtaacccatctggcattttggacaaccgggattttccaaaatttggcaaaattaacacgcattttggtcgttagggttattgtatcatctgtttggatggttacctggagtcatttatgtctgtagtttaaaatcaggttagcactatactttggaggcagtctttatctgtgaacgggcctaaagggtagtattcgaaatcaaattgttgccaacctgattactactatggatatctaacatagttgctttggcaaacatctattttgctttgtttgtcacaacacacatagtatttatattgtaattttataaaatacaaataattacttgccttaaattggatggaaaggcagtatcctcatatacaaagaaatatttctttgcaagtgaaaaattatagttttgataccagttttaataaaagaagtggtcattttaattattgaaattagaatcagaattcatttggctgcctttctttgtgtctacatcacagagtggtggaaaattaatgcagtattgacaaatttaggtcagaatgcaacttagccaataaaccaagatttaagctgcctcagtaacgtttcagttttccacctcattagcacatgcagactaacttttaaaagttaagtagatcatttgatacctttagaagtagttaggctaagtttatggttctacacaaaatagcattccattctttgtgtatgaggatacaggcttcctatccaaactcagaaatgcgtagcattaatattaagataaattctttagttacatttcgtgaaaataattaaatgccataatttctgacaaagtgagctagttgggaaaaagacatagtctttggtgaatagatggataatttagggaatgtgagtttgaaatattcttctgtatctgagctttcttttttcctttagtactaaaccatcctactatttccggttcctgatgatagaatgggattggcaatactaacttaactatgttctcaacaatgtaatttaaatgttttgctataaatatgtcctacaaatgaatacaagtgtttagaaaagctgaatgtttgctgggaatgagtgaaaataatccagtctgtttgggtgaattaggaagaatttgtatataacttgtaattcaagatgataggtaaaaaaatcattgttctaagttgtctggtgaattattttattgcagttatagatatcattttagttaatataatttccttttggaggggttcaaaaatgaaaatacaagtgccagtctgacaaatgtgagtgtgatttaaaaatcagtgttttaatttgtgatgagaatgatagaaaagcgagaatcatccataaaaacaacggaatacattgaggggaatactacccacctaaacagtaggacttctgtttatgaggttaaaaacttgtttttccattgctttttaattatatctaattttctaaaggaaataggcattatgtgctcagggatttacatatagtagaaagaatctcagcatataaccagtagctacagaggtaaataaattagccagtgtttgacaagtgaaaggtttctaaatgaggtgagtggaggcagaaagctttaggaactggttttgtgcattgcccttggctcaaaaatatcgaaaatgtatccttgttaaaattttgtcttttctgaaaattggaagtgacttttgatcatgaattccctaagggaatgataattctccaattggacagttataatgtggtccatagaattttcataatgcagtggcgatttcaggccagtctcatatgttacaatgctaaaataagtcagcacaattctgcagaatactaaactgtttatagacattggaaactctgatgccagctaataaaaataccttgaaagaggacttgaaatcagttcctgagttgcatgttaatgttaaacttgatggtgtagtatagggactgcccgatttttatcttgtaactgcaaggggaatataacattatgtgtatgtattttcctggagtttttttttctttttactttttttttcctgttatagaaaacactagtagagaagcatacacttatcttgagcctccacttctttcggtgcagtttgaatgcccccagtgtgtcactgtgtcaattttgccaaaattcttttgagagaacctgacacgtaacatggcagcctgatttcaggtttggttttcagatccaaaacatgcctcccatcccattcgagccctcaccaatttatcaaccaaggatgtatgttatttcctcaaaactgattatcacctgttctctgtggtctcagaaaccaaactcaggtttccaatcagctggcgtgacattgaacaatggcccattttaattgtgcagagcactgcaatttgtaaaacagtaccatgttcattgatgttctgcaggtctggtttgtgtttactgttccactatagtattggtatattatttatagaaaggtagaaaactaatgcagagtaataaatctttacagactcttaactcatctgactaaatactgtgaaggctataattggacaactaaaattgatatagaaattaactgattgtgaaaacttaaaatgcatgacttttttgaagaaatggtgctggaaacagagaattttatgaaattttaatttgttttgcaaacactgagtgtaggttagcaggtatttgtggcatgcaaatcttttggtggaaaagtcagggtagaacaagttttctggtctcttataatattactataaaattgtccaagtcttatgtatatgttcttgctaaatctagtattggacttcggatggtaagtaaatatctgtctaactgtgtcaatgtaaagcccagcctattattttaatagccattagtaggtgtctataaaatatttttcacttttttttactccccatatcttagtcttgttcagtaagagagagggaaatggtaactggctgatttacatagtccttgattttagttcacctcttaggctggcactattatttggacaatggattctagttgtttactgaaagagatatgatgccacaggccctgtttgcagctccaaagtacccacactgaaccttgaaatgcacctcagacctccttgactatgatagccatatcgaaccactttttcagcttcctgatcgaggttaaactgatcagcaatttaaagttttggtgctgggcaactggcctgagtgaatcattccaaatggatataatgacaacaattctaaaacttggcaccattcgccagggatatagtctcaataatccagtctaagccccaggttttggccagaacagtggcagtcatggcccatttctagtttcttttggaaaataaaatagcttttctgtttgagcagtcatatctctggttgtggaccaaaggaaaggtagaaatatcacaacagtggtaatgctgatgattctccttgttgactttacatctagggtaactttgtcattagccacaacctcagtgctgaaaataaacataggacatttagaagaaaatccagaactgattatgtttatctactttttagaagtatttcctgtgctataggaggttctttttctaattaggttctagtcccttttacttttattctcctggtgctttctactatagcattttactggtttttcaaatgaaatgaagaattgctatattgaggaaatgtagcaatatgcgattaggaattttttggaattttctctcgctatattggttaagcatcactttgcactcctgtattattcatttattaaattaacttcattgtgtgttttgtagtttaaaagatctttgcctagaaaaaagttcaacatttgaaatgctaaataaagtataatggttagcaaacagcagctcagccatggagtccaaaccaactcaccacctgtttttgtagattaagttttattggggctgggtgcagtggctcacgcctgtaatcccagcactttgggaggccgaggcgggtggatcacttgaagtcaggagtttgagaccagcctggccaacatggtgaaacccagtctctactaaaaatacaaaaattaactgggcgtggtggcacatgcctgtaatccctgctactcgagaggctgaggcatgagaatcacttgaacccgggagacggaggttgcagtgagccaagatcgtgccactgcactccagcctggatgacagagtgagactctgtctcaaaaaaataaataaataagttttattggggcacagccagcttgtttacacattgtctgtggctgctttcacactatcatgcagagttgagtgggtacaacagagaccataaatcataaatccaaaaatatttctcgtctggccctttatatggaaagtttgcttatcattttctaccttagtctgtctttacaaaatgcaaaacgtgtattttagctatttttttgaggatatttaaaatagagaaaagtgatcaaaattcattcctgtttgaattatggctgaaagtgaagagtcaaatgtgtggcattttttttcacactgagctatgtgaaagagctaatcaggaaaaaacaatctattgcactttcactttaagatattttatatgggtagatatttagttacattttgatttaaatgaatccaatgctttaaagtttttacttatgtaaaataatttagggaaagttgctaacagtaataatcgttctataagagtaatagaccaactagaacatatggagcataggctttcttaatcaaactctccaggaattgcatagatggatggatggatggatggatggattttatttttttcattgtacacttttatataattaaactttgatttttttaattcagaaatttcaatttacacacctgtttttagaaggatttccatcatgccaaagtgcaatataattgtgcacttgtgtaaacttttcccaagaaatttagagacttcaaatgtaaggactatttttttttttttggctttttaattcaaagctacatgctgttatggaataaaaaagcccagtatggctagccttttaacttctagttaaaagccagatctacttttgtttgaagttgtatggctttgttacaaatagatggcattaagaagatgctctccactttgttgtgactcatctttatattttaagaagtttggatttgttcaatttccccttgtttgtttgtttcttgattgcagtgcaagttctagttgagagcctgtgaagcttccacaatttcgtaggaggggaagatgtggaagaggatgcttgagacagggatgtacaaatataaataaaagaaaatcttagggtattggcaattcctctgctcatcgtttatcctaccgtaacaaagagtgcattttggaagctttctggggggataatttcagagggaagcatcaaaatatcatgacttctggacttaggatagaatccattgcaatttaatgatagattaaaatccatttgcattttctgcacttacattaaactgagggccagaagaggcgcttggggcttttaaacaactgctgctctccatagtatcgttttatatgatgtttcccaacctgtatagtactttcatagattcactttgtctcttctgagagaatattttaccattcttatgaatggaaaatgggccagtttttcatcatactatttctacatttttgttttataagaaatgaatgcatttcaataaggtttatgtgtcactaagagtgtgagaaactgtttggaagtatctgtgaacagaggcctgcacatagtaagtggtcaatatatgcttactgtttccgtgtatgaatgaaggggccgagcagccattcagagtccattctggctccctgggaatacttaattttagaaaccacacccgtgatggtaaatacagcagtgaaactagaatcaaataaaaaagaagtggaaaaaacaaacaatattcctgatgctaatttgatggggagttgttttagagggagtggaggagagacaaataaaaactttggagatttttatatggttaaggaaggctttccaagaaatagcaataaaaaaaagaatatactactgtcacatgcagcatggatgaatatgagaaacttaaaagccagacacaaaatagttcataccatttatatgaagtttaacagaaggcagaactcaatctgtggtgacggatgtcctcagtagcccaggtgggagggtcattattgactgggaaggggcgcaagagaaaaatctgggtgatagaaatgccctgtattttaatctggatggtgtataaatatctataagaattcatcaacttctctactttctatacttaagatttgtgaactttattgctcgataaaaatttaaatcataataatattgaaaataggtcatggaggggacacttgatttaacatgaatgcctaatagagtccttggaagaaaatcctagcaaacccctggtctaaaactctgctgagcttagcataggagacttttctgaataaggacatttcctattcatttttgttgcaaaacatttcaaaccccaaaggatgcttagcatgcagtaaaatcacatctgttgagccactgcaaggtgaaggctgctgaacatagttctgttgattctttgaggacttactactcaaaaacaatttcttttttctttccagattggcagattgctactctggctttactcctgggcggcgctgccatcattctcattgcattcctggtgggtttgatttctatctgcgtgggatctcgaaggcgtttctatagacctgttgcggtcatgctttttgcagcaggtaaacagattcattactttcaaatgagtattaaagtttcatgaacctttctaccatcttcctttcctatgcagaagaggtatgtgtttgctgcattacgtaaaaattgagaggcatttactatatttttaaggtaacttggctaaaggtttatcagattatcagttttcagtgtgttaagcatttcacagagcacaatggcagcttctaaacctctgactaaagcatgaacaaataatactgcctgacagggctattaccttaggaattgcagcaggtgtatttactaacagtcttttacatccagttttttccccttttttactgctcccctggtgatcttaaggcagcattattttttctgataaggaactgaaaacaaattccaaaatgtttacccttaaagatgtatatctctttgaaaatgtgtgatgtatgactccaaccattagacaagtcaattatatgaagtcaattgtatgttaattaatttatcaaccatcattgtatgaagcacagcttggattaaaatatcaaccaatgaaatgaaaagacgggactgtttagaaaaggggcttgcagactaaaagcccaatacatgatttgatgtgagctttaattttcatttataaaaatacctttgaatatattgttctttttgactcaaactgcaatattctgtggtgccttcagtttgccctgtcagtcatatctgatttgaagactgcaaagtaagcttctgtgactatcaataatgaagacactgacaaaaccatctaggctgttagatggatttttaaaagctgtttcaagattggaatagatgaaatttctcaggatttaaagggtagttggagctaaaaatacaaaacagaagtgttctgctgccccctactgtttgtgttcattttcttatacccatgaaggctggtcagaattgggggtgtcataaaaatgaaggtccaaagggctgaaggaatccagaagtacatctaattcaaatctttaagtgacttgctcaagatcgcatagtagctactggcagacctgggcctgggaggcttctgaatcttaatctagtggttcattaaccactgacttcctcacttatttatgcaactatttcttagatgcctattacaggctaaacacagtattagacacctataaaactggccacagtatcaccacagatactcactaatagagtagaaagcacaatttcaaaaaatattttgaagtcttagtcccagttattcgggatgctgagatgggagaatcacttgagtctgggagcttgacgctgcagtgagccgacagcacaccattacactccagccttggcaacagagtaagactctatctcaaggaaaaaaaaataataaaagtacctttttctgccgagacatgtgcagtacataaaatcaaaacagacacattactactaccgcttggaaacatctctatccgagacttcacacttacttgatttagtaccgtgtgctatgcctggtactcatatacactcaataaatagtttttgaatgaatgatataaaaatgactaaggcatgtagctcataatctggtggggtaaaacaggcatgtaaacaaataagtaactgtaatgaagggttttttttaagcaatttctcttttggggtcttaggaagcagctagtttcacatgactacaaagctaagaccaaaagacctcaaaaaagtaataaatatcaaaaggatgttttttcatatatttatgtttttatttatttaataaatatgttgggcacttacactatacaagtagacagtcttggtgttataaaatatactctaagggtttttactgaaaactgataattaagtctcataaagatagccaaacagattataaagattttgtcttcttttttttttctctgaggtcttttatttagggcgggcttattaccttcttgaatagttgctagaatagctaagagctagccattgctgtagcccatctaaaacactgtccttttttccacaactctctttctcaccagtcctataaatctagacttcagaattagatatttttataataataatgctgataagaatgattaattaagcacctgtcatgtgccacgtgctagacacttaacatacactgtctctgatataacaatctcaaagttagatatttattttctccgtattatcaatgaagaaacaggttcagaaaaattaagtaatttcccaaggtcattttaactagtaagttgtacatctagggtttaaattcaggatacctatctgacttgaaagcccgaatgaggattccccagttatctttacttcagtacatatcacatattggaaaaatcagtgcagaatcagccttgattttgaattcagttgccaactgtgcactgcagttggagtccgtcctgtaactccagttactccgtttctcgggagcaacacctgaaggcatttagtaccttgagatgtcataaagaccacaaactgattgatgcagcatgactgcaccatagcacataatgaaagttgtgcacatttccagtacagttgactacagcatatttctttttgtgtaactgacagtgataggtaatatatgatgtgattctgataactggcatccagttctcactaaagacttggtgaaattagagggactgcctcttgccacgttctcttcttttattgtctacttttgaactatccgcaggtcatttgtatgtcccacaggaatataggatgagtgttttctttctttccaaggcctttaatacaaattgcagaaaattctcttttataattcgattttacatacagaatccccatttattatgttattaaggatgattctttatgttatatctgcagaaagcctcctataaggattgtttttatagaaaggtgatgttttttcagggtcctgcagctgatttccatctctgagctatctctgattggaggcttgtgtcttacagccctcatcaccatcctataagtcacagtgagatagctggaaccatttcaagtctagattttggtagaaaaatcagtgtccagtttagatttcaaactaaaagagagttcttctattcaggatatttagattacatgttaatttccctgtaccgttatcaaactacacttcggctagaacaatttacagtatcacttcccaataattaatttcatactgctgccactagtagttacaaattaaattttaaaaagaaaagaaatggataccttcatattaaccttccactggcaaatgctttttattctccaaatcattgtttcttttatgtcaattttatatttagggaccaacctggctggtagggcctatcaacctttgcctttaaattatctcctaattttgtacctttttttcgtacaccatcattattgccttagtcgaggccacaacttttccctaaatggaacgtctcattccccaaatttggtcttcccctactttattttgtttttctatggcaatatctgactgttttaagatgtttatgtgactcctttattttgccttgttgagtatctagtttttcagttctttcttttagtctttctttagattccctgacttttctttcccactgatgacaccttagtcatcactgcctacaggtccccacacactgaatgaccttctaggggcctgtccttctctaatctcttccccatgtaatctgtcttggatacaacacatgaggtctccttgtgacataaacatctggtcttgtcacttgtccctttgatttcttcagaagcaaaccctgagacgagaaatcaagtgcatatactttatttgtaaggtagaagaagggatatgataaagagtatggaaaatgagacgggaatgggaaagcagccattaaaaggttacattatcaagccagttgtcactcgaagcagctggagcttaatcttcttggggaaactttaaaaaccggtgtagaacacgcacctcgagaataatctcattcagaggactacggagctggagtattaatgcaccaaatttggagcgtcattggttgagaaatgtcggttataatcaagggagagcagtgttaattttctggacctggcctgccccataggcagctgaagaggctttagtggccagaggtaactcaggcaaagaaatacaggtgctggcaattggaagtcagggtagcatgtactgaagtggggaagataaaaatatatggataggacaccaaccgcatatacaattacaataacctcgcagatggtctccctagagaaacaaaagtttattactttatgaaacactatggtattatagtatgaactaaacagccttgtgcatgcgcccttcattttacccatgcaaattgcttctagtcatactctcttaatagctgtaagcactatagaatatgctttgtcttcctagacgtcttttctttcctctgcctcttctgaccacctttcatccatcctttaagaaccaattcaaatgatgtccctctgaagccctcctttctttctctaagctgaatcagtacttggcacaatgtttgagctcagtaaatgtgtgttgaacatattataaacaaacatgcatgcctctactattgctgttgaatgcattgatttataattacttgtgtgcctgtctccaccatcagagtatgaatcatcaaagggcgagggccatgtcttatctatcttatccccttcatctagcacgtaggcacccaatatatgtttatcaaaatagtgaaatgtccttcttagaagaaaatattgaatatttcaatatcaatgctttgaatattttagtgttgaaaacactgaaaaatatccctttaaaactagaataaaacacaagaattagtaggtctacattcccgtcatgcctctgatccacacaatttcatggttagtagtttcattgcctgttttcaaaaaagtgcagggggcataaaatgaaccccaaatctcttaagattctaaaatgttccagagctgtacctatgttatctttgaggaagagcatagagaataccatatccaatgcctattttgtttcattgattggtagtaaaatagaaatatagtataatggcattttcctgacttctgaactctttatgttttttttttcttccctctacagcatctatgaaaggcaaggaggcatttttacctacatctgtgaattttattacatggagaaaattatttacaaatgcagaattatatttttctcagttttgctattacattcatttttctctgtgattccaaagggagtcgaataattcagaggcatgaagtgttttacagtaatttttattgagctccaacacaataaaagtctaagaaagttgttcgggagagtatgccagtagggcctaatggagttgtatttccatttttccactagagggaaattatatcattatattataccatggaggccaaatatttgctaaataaaacacgttgaaatgaatattaaaagcagcgtaggtaaacacctcactccagggactagtcagttcacaaaagaagcagtgtaatcattttagagtaattcagattagttattacttctctgctcaaactcttctaccagctgcctgtcacacgtagaataaaatctagaccccagatatggttcacaggctgtccatgaaccacgaagggcccctgctgtttcttccatcatatctcatgcttctcccttcctgctctctgtactgcaatcacagccttctgacttctgttccagtgcaccagatatgctcctgtgatgggagttttgcagtgcctatgcctttcacgtgggaatgctcagtccccactatgttgttctgcacccccaattcattcagatctgtgctcaatatctcctcctcagagcagccttctctcacgattgatctaaaagagcagccctcatccctgtgttctgtctgctttcttgcatttcttgtctcttagcaatatgtgacattatattctatatttgtttactaatggactgactacccatgagagtagcagctttgtctcttttgatagcataatgccttaaactgtatcgctttagaaacattcagatatttattgaatggatgcatttattgaatgagtaaatgaattactatacctaacccacattcttgtttcagtcatatcctggtaggatcagtacagatttgacgagtgaacagagtatagaaacctaaggagaagtgccttttttttttcaaatgtacttggcaactttggaattttcttctctgtagttatggttgatagtaattgacttcttgttagttttaagacatttaaaacatgaaagctcccttttcctcacaaaggcaaagagccaactgggctttttttaaaattaatgcacattttagcacttactaactggaaatagatgaagtgtgggtcatacaatatgccgtcagctgagtcctaacaacaaccaaaaccttttctgagaaggtctgatttctattttggatatcagtagggtatcctcttatacaaacttacttgtgtatccactctcagtagtaatggtaggcaaagtgctgactcagcagtgttgtgctacacggcagaaatgttgggtgtttttatatctagttctaggtcggtcctttgacacctagccagagccttatagaaagaaattttgaggaatcatttcctcatgaatttgctgtatttcatcagttttatgggagagaaagatgactgttatgtagactttctaggaatcttcatcatactggtaataatcttttacatgggctaaaaatagatgagagtacattttaaaacataaaattccattttaattaaacactctatccatcctagtgttcttttttaaaacatataagcgatatcaaaactatttatgtatatagttttactatgtcagtttgttccctccttttctttaattattcacatttttgttcttttcagatgaattaaacaaaaattattttaccccctaaaattatttcatatatcagaggttagcaaactttttttgttaagggcaagaaagtaaatacttttggctttgtgagctgtgtggtttcttttgcagcttctcaactctgccattgttgcatagaaaatacgtaaatgaatgagtgtggctgtgttccagtaaaactttttcaaaaacaaaaagcagaccagatttggtagtttgccaacccctgttaaatataactgtactctgtattttttagggaaaaagattgtctatttcttgagggtggaagctgtcctatggtagagaatgaagctgtagttaactaattgtagttaaactaattaaaataaaattacataataattgatctaataggaagttaagaattttaagtggaagacattatgtcttgtgcatatccacaacataaatttcattttattttagatagtagaaacaacacaaaacaaaacaaaaacaaaataaacattcccttcctgattattttggtttattttattcggtatgactaatcatatttcccctttggccctgacagaagtaggatctaaccagggactaagagctaagttttgacctctgttacagtagccataattggcctaggttttcctgtaccattatctctcttgcctttatcgacttaattcttttttgaaagtaggtggaaaacagatatgaaaatatcatctgttaataacttttaagccactttttaaagacaagaggcatagagtggatgagaagaaaataatgaaagtagctttggatcagagtaatgtaagcaaagacatcatggtgagactttctggcatattgggctgagttagtattgcaaagcagcaacaacatcaaaagcacattatcactcacaggatgaccagttgcatcagtagaaattaatttgaatttcctaattccttaatagcataaataaataacaagagtttcagttggcattggggtcactattcttttttttttttttttttttttttttttttttgagacagagtctggctctgtcgcccaggctggagtgcagtggcatgatctcagctcactgcaacctccccctccctggttcaagcgattttccagccttagcctcctgagtagctgggattacaggtgcacaccaccacactgggctaatttttgtatttttagtagatacggggtttcaccatgttggtcagactggtctcgaactcctgacctcatgatccacctgcctgggcctcccaaagtgctggatttacaggcgtgagccaccgcacctggctggggtcactattcttgaggagctacttatacggtttattagtggcacaatttagtttaactagtactacttgccataataataatgataattatatttttaaggtgaaaatcactactttgtatgctcatataaattattatattgcactaattattttatctatactaataatgatttactaattaataggataattcttatatattgggaaaaggtatttaaacaaaaaaattattagtattttaaagtataccatctagaacaagccatctttaaaatttttggcttttatgtatatttgattacaaagttactctcatacatatatagttacatatttatattattttatttgctgcaaataacattttctaattttgatttgcttttctttcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatgtggtttga

SEQ ID NO: 37293 - DNA, 30224 bp, Homo sapiens; identical to SEQ ID NO: 37292

SEQ ID NO: 37294 - DNA, 788459 bp, Homo sapiens
  misc_feature (106202)..(206201): n is a, c, g, or t
  misc_feature (390258)..(490257): n is a, c, g, or t
accctcctctccaaccctcgtaccctcagaccctcggctcagacccacagatcctcttctacaccctcagagcctccgctcacaccctcagactctcccttcagaccctcaatcttcctctcagacccaacgaccctcctcccagaccctcagaccgcccccctcagaccctcagaccctgagacccttccctcagaccctcccaagacacccgcagaccctcccctcagatgctcccctcagacccttggacgctcctctcagacccacagaccgtcccctcagacacacagagcctcccctcagacgcagagaccctcctctcagaccccccaacccttccctcagaccctcagaccttcttctcagaccctcagtctgtcctctcagaccctcccctcagaccctcagaccgtcccctcacactttcccctcagaccctcatactcaggtgggcagagcttctgccagtgtagatcatggtgccgtcttcccgcgcggcactgctgtcgtcctggtcttccgagggcgtctttctgtccgtggctttccggcagggccctcacctcttccggtgcgcactgctcagcccttcgcggctcaggcctgactgaaagcacccgtggtccctgagcctcgtgtgcgcttgtcagcagagcctgttttgtcctcagtctgtctggtctgagctggcgtggacatttgctctctgggtgcatcacagagacctgcagggccctggcgctcagaagccagcgtgaggttctaggtctggggccggggcgggcgacagcggggctcggagccaccgccacagccctgcccgacgtaggtaattcacccctttaataaccagaagacggaaagaaggaaaaggtgcaggccagagggaacccgaattccctgttgagtgcgactttctttctttttgcggtccggtttctggtcagtgtcctgaggacattatgccatgcagggcggttccgaattgcctgggcccagcctggtgttgccacggtccccaccccactctgcagccctgtctgatcctgacccagttttcttgcccacccctgaggctcaaacactgtgatttgagctcagacaaggtgagtctcaggttttgagtgagaatgtttcttttaaacgttggtttgataattttctataaaaggctgaaccctgaattgtttctttttcagcctgtaccaaaacgtcaggtggtctcctccggccgtgcctatcaccaccagcctgtgtctccctgtgaaatatggtctggttccatcatggatttattttcccgcctcccagtaggacagatctcagctctttaggccgacaacccctgacagcaactcagccacctcctgccctcacccttggagccctgtctactgatggctcacttggagcctggcttggggtgacctctgtgccagggtgtgcggtcatttccctggattcttgttagagtcctcatctgcccaaggagatgatgaccctgagctactaagaacaggcttccttcatgtcaggacacagagacaaacatgcgcaccacgtaagggaagggaagatggtaaagagaaattggtgaacaaatgccgcggccaggcaggtggcgcgaatgagctgagtgtggcatcagaggggtgggaacttggtgccgctcagccttggcaggcagctgctaagtaggaatgcacaaacactggccagatcatctgatttttaaaaagccagaaatatggacttctgtataaaattttgtgatttttaaatgttggcaatgttctttgctttttttctttttaatcctgggtagggtaaaccaccagtttccgacttctgtactaaaacatgttctctagattttttttttttttttttttttgagacggagtcttgctctgtcgcccaggctggagtgcagtggtgcgatcgcggctcactgcaagctccgcctcctgggttgacgccattctcctgcctcagcctctggagtagctgggactacaggcgcccgccaagacgcccggctaattttttgtatttttagtagtgacggggtttcaccgtgttagccaggatggtctcgatctcctgacctcgtgatccgcctgcctcagcctcccaaagtgctgggattacaggcgtgagccactgtgcctggccccatgttctctagatttttaaaactaagattttgttttatatatttatatggaaatacagaaaaatgccagaaaaagtgcctataattttcactgttaacaaaattatataaagtaagaagtaaaagtagctgtaagatccccttcacttctccggtttgctgacgtgtggtagaggagaggccatacaggtgaaggtctgtatgcggcggtcaggtgagccctggaagtgggcaggatttggaaggactgacaatgaggagagcttgccctcaggtaggaagacagggttgatccttatctttgtttcagtggcagctgcactcttgcatgcatggtccagttctatctcctgtcttatatgtccatggaacataacaaatcctagtgtaaccacagccctacccaagaacatgatgagacacaactccctaagttttccccccgaaagtaaccaaagaactactctgactttgacacttgttatcctttctagcttgtctcttttcttatatacatacatatatacataaatatatatatatatatatatatatattatgcatacatgagttttgtctttttgtttttaaactttataagaaggatatgatatatgtgggcgttagggacattttacttcattcattctcacttgttaccctattgtgggaatactcctcactttgcttatctggtgtcctacagttgaacatttgagctgccttctgcttttttgttagcgtaaacattgatgctgagcatgatccctgggacaggtcctgaatgtggaattgttgggtagcagggtgtgcaaatattcaacctaataggattgtgccaaattattttcaaaagtggctgtatcaactcacactcctactggccatgtgtaagagatgtaattggcccacagccttcccagtatttgctattgtcagacttcttaaagtttgcctgtcatatgggcataaaatgatttctgattgtggtcttgatctgtagctccctgataattaatgagaccaagaatcttttcatgtgtatacatattggcccatcgacaacactgactcttctgagccgtgaacagcatatacctttatgtatttagttcttctgtctttcagttgtattttatagtattgtgttgtacgcatttttcattagagttgttccttgtatttcatattttgttctattgttaaattggatattggtttgatttcttttggattggtttcttactgtttattgctgtattgtatatgtatagaaaggtgcaaatatcacaagtttacagcttgatgaattttcattggactcacctatttaacctagacccagatgaataaaacacagcttccccagcaccctaagaccccctgtgttctcttccatttatttccactcctactcccaccttccaaccagcagcctctgtcccaactagattcattttgcttgtttggtactttataatcatggatccacacaaaatgtagtcttttgtgtcttgctactcttgctgaaaacagtatttatgaggaactttaccccattactgcctgtagttgtggacagttcattccattgtgtgattctatcggaatttgtcctgttgtcagggagcactgtgacaggtcccagtttggaacaattacacacagtgctgcctatagacactctagaagatgtcttttgatagacaaatgcattgatttctcttggatatattcctgggagtggaattgctggaccatggagtagttgtatgtttgacttcgttagggaatgtaagtcagtttttcaaaagaattttaacatttaacactcccaccaccaatatatgacagttccacttatgtcacgttctttgccaacacttgatgttgtcaatcccttaccttttagccattcagataggtatgaaatggtatttgcctatgtttttaatttgtattttctgattactaaagaggctgagaacattttcacatgtttcttggccatttggatttcttctttactatagctcaagtctttttgacaatcttataactgagttatttttcttttatttattaacttgtagttcttaattgttctggatatttctttgttagatatttgcgttgtaaatatttccctagtctattaatattttttaaacttgcttttgatgagcaagagttttaaatcttgaaaaagtccaagttatacattttttcttttatacttggtgctatttttgctctgtttaaaaaattcttgcctatcctaaggtcctgttttcttcaaaatatctaatttttgctttcataaagctaaaattaatgtaatgtcatacagtttaatttggggggtttggtgtgaggtagagatcaaagttcattttttttttttccatatgagatccagctgatccagcaccatttattgaaaagacttttcttttcccatgaatggtattgatgcctttgttgaaaatcaagtaaatataatatgtgagtctattttgggattttctattctgtgtcattggtctctttagctatatttatttatctgtatgccatcactacactgtcttaatgtggcattgaaatctggtagtataaatccttcaacattattgttcttcaagattgtcttggaattactgggtctgttggtattctacataaaatttcaagttgggttgtcactggaaaatcccagactacttgttgattaaacaacacgcttgtagataagacatgggcctgagtagaatttcaagagaaatttaaaaatctttcattgacctaaatgaaaatgaaaatacaacttatcaaaatttgtggggtgcagcaaaagcagtgcttaaaggagaacttatggcattgactgcatatattagaaaaggatatctaaaatcaatggtctaagcctccactttagtgaactagaaaagtatgagcaaattaaattcaaagtaagcagaaaaaagaaataataagaattagagcagaaaccaatgaaatgaaaacaggaagacaatagcaaaaagcaataaaaccgaaagatggttttttgaaaagattaataaaatccataaacttctagccaggctaaggaaaaaacagagaagacagaaattgccaatatccaaaatgaaagaggggccattagacctcatatagaactcatggacattaaaggggtaataaaggcatatgacgaacaactctgtgcctgcaaatttggtatcctagatgaaatgaaccaattccttggaagacacaatctgccaaaactcacacaaaaatagacaatttaaatagacctaaatctattaaagaaattgaatcaataatgaataacagaaagcaccaggctcagataggttcagtggtaaattttactaaacatttaaggaataaattataccacttctctacaatcttttccagaagataaaagcagaggaatatgttttaatttattctgtgaggccagcattaacataataccaaaactagacaaagacattacaagaaaagaaaactacagactcgtctctcttatgaacatagatgcaacagtcttcaataaaatactagcaaatcagactggatgtagtggctcgcgcctgtaatcccagcattttgggaggccgagacaggtggatcacctgaggtcaggtgtttgagaccggcctggccaatgtggtgaaaccccatttctactaaaaatacaaaaattagccaggcgtggtggtgggcacctgtaatcccagctacttgggagagtgaggcaggagaatcacttgaacccgggaggcagatattgcagtgagccaagattgcaccattgcactctagcctgggagacaagagtgaaacactgtctcaaaaacaaaacaaaacaaaacaaacaaacaaaaatacaaaaaaaaaccaaaactagcaaatcaaatccagcaatgtataaaaataattatacaccatgaacaagtggaatttataaccatgaccaagtggtatctatccaggtctgcaagattggttcaacatttaaaaatcaattcgcacagtcacattacattaggagaaaaatcacacgatcatatcaatagatgtagaaaaagcatctgacaaaatccaacaattatttatgatttaggaaaaaagactcagtaaactaagaatagagggaaagttcttcacttggtaaagatatctacagaaaacctacagctaacatcacacataatatttagaaactagatctttcctgctaagatcaggatcaaggcaaggatgttccttctcaccaatccttttcaacattgtactagaagttctagcaagtccaagaagacaataaaaggaaataaaatgtatacagattgggaaggagaaaacaaagcttccttagttaccagactgcctgattgtgtatgtagaaaatccaaaagaattgtcaaaaactcctgcaactaataagcaattatagcaagattgtaggatataacaaaaataaattgcttttctatatgccagtaaaaaacaagtggaacttcaaatttaaaacacactactatctacagtaacactaaaaaagaatgaagtacttaggtttaaatctaacgaaatacatacaagatctttatgaggaaaaccacaaaactctggtgaaagaactcaaagaaaagctacataaatgagagacatcccatgttcatggatagaaagacttaatattttcagaatgtcagttcttcccaacttcatctctagtatagattgaatgcaatcaatctataaactcaacagtaagaaaatgaacaatttgattaagaaatgggcaactgggcccggtggctcacgcctataatcccagcactttgggaggccgaggtgggcggatcacgaggtcaagagatcaagaccatcctggccaacatggtgaaaccccatctctacaaaaagtacaaaaattagctgggcatggtggtgcacgcctgtagtcccagctacttgggaggctgagacaggagaatcacttgaacctgagaggtggagattgcagtgagccaagatcctgatcttgccactgcattccagcctggtgacacagtgagactccatctcaaaaaaaaaaaaaaaaaagaaaaaagaaaagaaaaaaagagaaagaaatgggcaaaccagcatggtggctcatgcctgtaacctcagcactttgggaggccgaagcaggcagatcacctgaggttgggagtttgagaccagcctggcctggttaaactccatctctactgaaaactcaaaaattagctgggtgtggtggcatgcacctatactcgggaggctgaggcaggagaatcacttgaatctaggaggcagaggttgcagtgagctgagattgtgccactgcattccagcctgggcaacagagcaagactccatcttaaaaaaaatatgaaagaaagaaatgggcaaaatacctgagcagacacctcaccaaagaagctatacagacggcaaagaagatgagcatgtgacaagatgcttcatatcatatgtcatcagggaagtactaattaaaacagcaaggagataccaccacacacctattagactggcagacaaccaagttgctgacaccaccaaacgctggtaatgatgtgaatcagcaggaactgtcattcattgctggtgagaatataaaatagcataaccactttggaagacagtttggagtttctgacaaaactaacagctgggcacggtggctcatgcctgtaatcccagcactttgggaggccgacgcaggcggattacctgaggtcaggagttcaagaccagcctgatctacatggagaaaccccgtctctattaaaatacaaaaaaattagccaggcgtggtggcgcatgcctataatcccagctacttgagaggctgaggcaggagaatcacttgaacccgggaggtggaggttgcgatgagccgagattgcgccattgcactccggcctgggcaacaagagtgaaactccgtcccaaaaaataaaaaataaaaaaataaaaaaaactaaacatacacttaccatgtgatccagcaattgtgctccttggtatttaccaaaatgagtcaaaaacttatgtccgcacaaaattctacacatggatgtttatagcagctttatttataattgccaaaagttggaagcaaccaagatgtccttcaataagtgagtggataaacaaactgtgatacatccagataacggaatattattcagtactaaaaagaaatgagctatcaggctatggaaacacatggagaaactttaagtgcatattactaagtaaaagaagccactgctgggggcagtggctcatacctgtaatcctagcactttgggaggccaaggcaggtggatcacctgaggtcaggagtttgagaccagcctggccaacatggtgaaaccccgtctctactaaaaatacaaaaattagccaacgtggtggcacgcacctgaaatcccagctattcgggaggctgagacaggaggctaacttgaacccaggagatggaggttgcagtaagctgagattgcgccactgcaccccagcctgggtgacagagcgagactctgtctcaaaaaaaaaaaaagaagctaatctaaaaaggttacaactatatgattccaactctatgacattctagaaaaggcaaaacaatggagacagttaaaagatcagtggttgccaggaattagaagggagggagggataaaatgacagagcacagaagatttttagggcagtgcaactattttccatgatactataattgtggacacgtcattatacattcgtccaaatcatagaatgtacaacaccaagaatgaactctaatgtaaactatgaactatggatgatgatgatgtgtcagtgtaggttaattgattgtaacaaatgcaccactctggaaggatgttgaggcgtctgtgggtagggggagagaaagaaggtatgtaaggactctctgtactttctgctcagttttgctgtgaacttaataatgctcttaataaagtccgttttttgaaaaatgaattgtcaacttctactgaaaaaaaataaaaaaagctgagattctgattgggattgcattggatccataggttagtttggggagaagggctatcttaacactattgcgtcttctaatccacagatatgttgtatctccaatatttttggtctactttagatttgtaaagcaatattttgtattttttcaaaataacttttacacatctaaattaattcctaattagttgctatttttcatgccatcataaatattcttaaatgacatgaaaatatttttaaaatatattgtccaatagtttgctggtatatagaaatgtaagtgatgttattttgcattgaacttgtatttagagagtcttgtaactttactgattaactttgagtccttggtgctccagatctgcaatcatcatctgagaataaaaagaattttacctcttcctattcaatatttgtgcctttttatttctttttcttgtcttgttgcactggttaggactttctgtttcatttgaatagaaatgggatttttctcttaattatattgcgaatttcaaaacacagagagattgaacaaatagtaaaatacacaatcatacattaagcagtttttaaaaatcattttgccatattcgttctctctcttccccttctgtctctctctcccatatgaaagtacatacacaaaaatacacacttttatctgaaccacttacaaataaatagtcaaaataatgacacttagtatctaaattcatcactgtgcaccttttctaagaataaaaataatctcccaaactaccaaaatgccattatcacatttagcaaaataataattttttccttcttttacctaatatttggactatgtaaggtctttccccattgtcctcaaaatatcctttatagcttttttagaaatagttttattgagataaaatttacatactatgcaattcacccacttacagtacatgatggtatctttgtatattattaattttttaaattaaattaataatttaaaaattcagaaccagttcactgttctgaactggggtatattaataattttttaaaactatggtgtgtatatatatatatatatgtgtgtgtgtatgtatatcttgccattttaaccatttcaagtgtaaaattcagtggtattaattacattcacagtgttactaattacttccaacatttttcatcacccctaacagtgctttgtaatcattgaggagtaaccacctacccacagtcactggtaactgctaatttactttttgtctctatgaatttacctattctggatatttcatataagtggaatcacaccatatttgtccttttgtgtctgacttactttacttagcatgatgttttaatggttcacccatgttacagcatatatcagaatttcattcctttatatggctgaataataatccattactggcacatgctatgttttgtttatccatttgtctgttgatgggcacttagggtctttccatcttttgactattgtgattaatgctgcagtgaacattggcataccatgtcaaacatacatgcttgtgtgtgtatatgtgtatatagttgttccttagtatccatgagggattggttccaggatcctctgtgataccaaaatccatggatgctaaagtccctttttaaaaatggcatagtatttgcatataacccaaacacaccctcctgtgtattttaaatcatctgtagattacttataatacataatgtaatgtaaatgctataaaaatagttattagactgtatttagggaataatgacaagaagaaaaagtctgtacatgttcagtacagaggcaacctttgtaggtctaaataaatttttaatacaaggttggttgaatccatggatgtggaatccgcagatacaaagggccgactgcatattgttctattaatgtgatgtgttacattgattatcttatgttgaaccatctttgcattcatggaataaatctcacttggtcattgtgtgtaacaagatgaaagatacaagtctacaaatccaagaagttcatgaacttcaggtaggataaactcaaagaaacccacaccaagatacataatcaaactcaaaagacaaagagaattttgaaaacagcaggcgaagtgatttgtcacttataatggattttcagtaagattaatagccaatttctcattagaaatcatggaagtccactgcctagtggaatgatacatttaaagtgaagggggaaaaaaaaaacaaacactgcaaaaaaagccaaaccctgccaatctgtaaattctatagctggaaaaactacccttcaaaaacgagggaaatattaagacatcccccagaaaaacaaaagctgaggagttcattaccactagacctgccctgcaggaaatgctaaaggacagatccttcaaggttgaaatggaaggacaccagatagtaactatatgaagaaataaatgtctttggtaaatacatggtaagtacatgggcaagtagaaaagccactattattatatttttggtttataactccactcttttatttcctacatgatttaaaagacaaatacacaaaaataattttaaatctatgttactgggcagaaaatgtataaagatgtaaatggattaaactcctcagtcaaaagttatagactggcaaaatgaataaaaaaacacattttatatgctgtccacaaaagactcactttagatctaaggacactcataggttgaaagtgaaaggataaaacaagatattcatgcaaatagtaatcaaaagagaggaagagtggctatattaatatcagcatagattttgagtcaaaaactgtcatgagtaacaaagaaggatatatataaaagggacaacttttgaaaaggtcaattcaccaagaagatacaacaatcataaatatatatgtactaaatatcagagcttctaaatatacaaagcaaacattgacagaatttaagggagaaacagacaactctataataatagtaggagacttcagtgcccaactgtagatgttggatagaacaaccagacaggagatcaataaaaaaaaaaggacttaaacaacactatagagcacctggacctaacaggcatacatagaacatgccactaacaaacggcaggatacaattttttctcaagtgcacctggaacattctccagggtacagtccctggagacatttcctataccttgtgagatagcagtgcattaaagaataagtcttactcggagtttatttattgccatgcttcctagttactcatcaacccagtaagcaggtcaatccattgaagaattttttaagcaagaagcagcatgacctaatttatttatttctctctctctctccctcctttctttcctcccttccttccttccctccttccttccttctttccttccttccttccctccctccttccttctttccttccttcctctctttctctttctttcctctctccctccctttcttccttccaagtcccactgtgtcactcaggctagagtgcagtggtgtgatcactggtctcaaacaatcctcctgcttcagtcttccaagtacctgggactacaagtatgtgccaccacacttggctaattttttttttttttgagatggggtctcgctctgttgcccaggctggagtgcagtggtacgatctcggctcactgcaagctctgcctcctgggttcatgccattctcctgcttcagcctccccagtagctgggactacccagagttgtgtctggcacttagcccaccaccatgcctggctaattttttttgtatttttagtagagatggggtttcaccatgttggccaggatggtctagatctcctgacctcgtgatccgcctgcctcagcctcccaaagtgctgggattataggcatgagccaccgcgcctggcccatgcttagctaatttataaaaaattttttgtagagacaaagtcttgctacattacccagcctggtctcagactcttggcctcaagcaatcttcttgccttggccttccaaagtcctgggattacaggcatgagccaccatgcccggcctaatctccaattttaaaatatcactctgctgaatagataacagattagattatacaagattggatgaagggagtgatttttatagtcctcaatggagaggatgctatctcggccagggttgtagcagaggaggtagaaaaacagaggaattaaagacatgtcaagttggtaagtggttggagtgagggcaaatgaagtatttggcttctaggtttctgtatgaaggactgggtggatgtcttagtctgtttgggctgcttataaaccactgaaatttatgtctgatgagggtcttgcttgctggttcatggacagccatctttctgcagcatcctcccatactggaaggggcacaatggttcttcttgagcctcttttatcaggcttgcgcattgccggctgttgccctccaggcagctcctcgtgtttagaaaatgcacctaaacacggtgggaggcaggtgccccctgccccctcccaccgttgaagatgcactattactttgctgccatccagagtgggaaagctaggggctggaggacgcacagcccttggaaagctcccaggcaggacgtgagtctggagcacagggctctgatgagatctggcgcagagtcattctagcatctgttcagtgtcctggttctgtctggactggctgcttggttcttgcttgcattgctttttttttttttttttaatccttttgagaaggagtcttgctctgtcacccaggctggagtgcagtggcgcgatctcggctcactgcaacctccacctcccaggttcaaacaattctcttgccttaacctcccgaatagctgggattacaggtgcctaccaccaggcccagctaattttttttgtatttttagtagagacagggttttaccatgttggccagctggtctcgaaaagagaccttgtctctcaaagtgctgagattacaggcgtgagccactgcacccggcctgctgcgtcgtttctgagctagcaccttgattagcactgatcctgcagtggcctgctttcagctcatgctggccttggtttgtttgcatcaggacccttggttcttcatcttctgactgatgtcctatctcagatgtctttctccaaccgatcctcctcacctctctgaaacatgagtctcttcatcaatcggaagaaactgccaattgtctcccaatatctgttctccacgttattcttttgtagatctttaaatgcttaggcagtcatatggcccagggtaatgactctatttccagcatcttctaggtcaatgtggccatgagctaagttctggataatgggacaaactgctaagagcattttccaaaactgatctgtttctgtttgtgcacacacacacacacacactcagacacacctgtgtactcagctggtcatagtctctctcaattgtcaccttctccatgaagtgttgccaactgtgtgcacggagaaatcattgttctgtgcttccataccccccttcccaatcgtgaatatgagcttgtcccaccaggtcacatccattataattgcaggtgcatctgtctctccagtttgactctgggcagtctcttattaatctgcgtaatatcagcacccagagttgtgtctggcacttagtaggagctcagaaatgcttgcggagggaggaatgcagggaaggcaagggtttcgaaactgtggtttcgtcttcttattaacaaactatatttttatccacgtatttctcagttaaaggaacgtgcccatcacagaggctaagatcacttatccacagtgatgtggtgccccatcatctcagcattggtgtcagtggatgctaagatccttctgtgaatccgtaagaggagtgggcaggcagcacaaaaatgcccaaaggcactcaattgcatgtgaggccacatttctcaaacaaaattactctgtaggctcctggtgctggcttcaccttgggctgaggacaaatgggtgctatggggaaaggagatgacgccaggagaacacagatctttcaacctgaaatcatgggactccacaggacatcacctgacatcatcttagccagagcgaagcaagccgcagggcaggcacacttcaggagaatctcggagtcaatggccaaggtaccaaggggtctctcatcacaaaagccagaaaagaatccagatcaaagcaagggaacatgtctaaggagtaggcaaaattggttgattcgggtaaattcaacttttataaatctggtgatatgatcctctagaatttgtcagatccaaggggtgattttgaaagaactgtggtttcagactataaatgaatgcgacagtctttaagacagaaataatattatagcatgctaatgtggcaggatcacaactgactttccttccaagagggagaacttgggatttgaccgggaattttaaaaaggagcaataacgcagtaggagagagacaaaaaatgtctttgtgtctgggggtggtggggggacttaggagtgttgatctgtgagagcaaaggagagccacacgggacagacctggaggttgggaaagcgcacagattttcctgtgttttatgatacactcaaatacacagagcaaagttttctagagatgcctttattgacattttactaaagatcaagaaaatgccatttacgcatatccaggaatattattttttaactttccccataaattccatgagtccctgcctcctgcttgtcctcccactgaaggcctcttgccatagtgatggaagaaggcagaaaataggagatggttggagaaaagaccaatgtcatcgaggagggaaacaaaagacaatctggatatgtaatcagcagatttagaattaaaacagggttagaaaattctctctctctgaaagagaggacagtttaatgggggtgtggaattggtggggagagtttgcaccatgcctggagactctggagcagacacacacacagcttttgcgagatgaagacttttcctgggaaggacacgttcacttctagtaaaacacagcacaggccatttccatgtaatatttgggacggtagctgaatctggtgcccacatgcacaaaacaagacagtatctggccccaaccatagggctgaacccagcctctggcatgtggtgcaagtcaacacctgaacgagtgcatcattcaaagaaccctatctcctaaacagcccaggctccagagatacagggaggccaaaggcttagataaattccgagggttatgggcttatttaggaagtttgcatttcagcaacccaatcgagagactgcaaggcaaggcagtggctaaaaatatttggatcatcaaccaaaattttagagggaattctgttaacttttgttaagagaaacgagggctttctgtggaacatgtggctatggagaggaaaaagggagtaactttttgcccttttcctaagccacacagagcaccgtgagcattcattgccgcagtgcctcgtgcgcgttcggagtatctcagtacagtgatttttgtgcagaaacttctttgaataatattagttatcagccatataaacattgttgaattatcagaatcctgaatttgtggggaagacgtttaagaccccaattttggaccctacgtgtgtatcctcctaactggagcccccaggtctcagggagaagtccccagaggctgggagggtgtcactgttgccatcagggctcaaatactgacatttaggaacacataaagaatccctgtgaaacagaaggaacggacctaggaagatagggccatttgaggaacatcagtgttctctaagtatctatttgtgtgaaccagctcgcagaaagtgagcgtttctggtagtcttcaaagaagaaacgggtgctaacttgtaagcagtttaagccaagtgaccagagctttagggggtgcggcgttgcctgaggggcaggagtggccaaaatcagcataaaacgtgcaaagtgggctgtcatgtaataatacaccgcacaggcagagaggcctttggtcagctcctcaagtcctctgtagatgttccttaccctcggcgcgcaccagcctctgccgcctgctgtggccctgaacttcggactcttctctggcctagcccgcccttggctggggtgctcgggcctggccctagcggcggggccctccagggtggattaagtctccaagactccgggaccaccaggctcaccatgcaatgaaactgtttctggagttttcctgtccctgctttccctcccgagtcccgggccaggctgcgtccggtgggcaccgaggacgcccagaattgttgggaatctgggcggaggcccgtcgtgggcttggaggccaccgggtccagcagaggcagaggcctctgtgccacgcacgcacacacacctgctctcctccgtgtgtccacatacacacgtctatgcacacacctgctctccatacatgcacagccccacacacagtcggccctttatgtgcacacacactcgtgcacacaagcggccccctctcctccgtgcatacaggcgcacacacagctggctctcctctttgagcacacacactcaagcacacacccggccccgctcttccaagtgcacacacactcctgcacacactagtccctgctcccccccccacactcgcgcacacagccggcactctctgctccctgcacacaaacacacatcctgacatacccggccccctacctgctgccccatgtgcacacacactagtgcacacaccagtccccgctccctcacatgcacacacactagtgcacacaccagtccccgctccctcacatgcacacacactagtgcacacaccagtccccgctccctcacatgcacacacacgagtgcacacaccagtccccgctccctcacatgcacacactagtgcacacaccagtccccgctccctcacatgcacacactagtgcacacaccagtccccgctccctcacatgcacacactagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacacgagtgcacacaccagtccccgctccctcacatgcacacacactagtgcacacaccagtccccgctccctcacgtgcacatgcactagtgcacacactagtccctgctcccccacgtgcacacacactcttgcacacagccggccccgctcccccacgtgcacacaccagctcccgctcccccacatgcacacacactcgtgcacatagccggccccgctcccccatgtgcacacacactcttgcacacagccggccacctctctctccggacacacacagtcagaggcgcgcacaaacacagtcccttggccgccgagcgcacgccgcgcgcgcgcactgcccgtcccggcgcaggccccagctacatctccgcacgcgcacgcgcacacacggacacgcgcgcacagcccctccccgctctcccagggcgcgcagcactggcgggaggagcgggagaccgaggagcagcagaagaggaggaggagggcgccgaaggcgcgaaaaggcgcgcaggcgcgctgcgcggagcgggcccgccgccgcccacgtcaccgcgccgcgcgcacgtcacgccggcccgacgctcggccagggtgagccccgcgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccaggtgcgggtgggcaggggatgccgcgggagccgcgggcgggagccgggggtgcgggcgggacccccggccaccccatcccttgccccggccgcgtgtaggcgccgcgcggccccgacccgcgccctcccgcgccctgcgcgctcctgtgcctcggggaccccgcgcgctcggcgctggtaggggctccccaggtgaccgcggggcgggggtcccgggcccggccctcccggccgacagcagcgtccgcgccccacgctggaggtggggccggggccggggccggggctggggccagggtcggccggagcgcgcagggcgggggaggggaggccgccccacggcggcccgcggggacccggttccggcgcgcgcgggaggcgcctcgtgcggaggcggcccgaggcctagtgacaggcgcgcggcgcggaccccggaagcccacctgtcagagttaccggtcagccgggcgggcgccgccggggtctggggtggacgccgcgagcctgcacgttgcgccgggaccccggggctgtgcccaggtgggtggtggggcacccccctgcagcggcgggagggaggcgctgcgccctggctcctggggctcggccccaccctcggccgctgggcgggccgtcggggacctgggggtagtggtggtgaccctgcgggcccgcgggccacttttccgcagggggcatttccgtctggcgaggcgactgaaaatcctgagtgtgggagtcggtttggccagctccgctctcaggatggagggtgcctttgggaaggaaggtccgcgtttcctttgagatgtgttattttttaaacttcgtttttcattcttacttatttcttgtttttccttacttttttttttttttttaccagaaaaatcatttttcttctctgggaaggtgaacatttgtagcattgatttcccggatctggtaacatggcaaaagatgtaagtatgtttgcttcatgctgcacacgaatgtttgcctcgcactaaattctttgtagttctctgcctttatttcagaatgacaacacataagctacagtagtgtttattttcagacttttaaagcgtctgaagcgggatgaaggtgaaagatggaaggatctgatctctgaagctgcggtcaccacccacaagttgtggccttggataccacactgcagttgggtggtgatggggtggtgccttctgactttttccttatctttaccgactgtgttaattgataattttaaataaacgccttaattaaattgaggtggagggtgttgcagcaccgcagcgaatcctgcatttcttggggggcttccacatgagacgctggacgggggccaggctcagggctcaggctgtagccacctgctggcacctgtcttcctacagaggaagttaattccacttgggtggaccaagagctaaggacttgttttggccactttttttctcagaaggatgagatttcctgatttatgaaatctggtaaaaaatgctacttagcctgctttgcagttgtcatgaaactatagaatattttgaaaattttttaaagccagaaatttagtctattttattggtgtgcggttctttaccgtgcttggttatgtcagtcactgaaacaccagctggattctttagtgtttcccaccgtgcatcgttttgtaactgagtgaaaggtgctgttgatgtgtttacctacttaccgcacagagttggaaagagtccgcacatgctgcctctgcctgagatacatctgtagcgaaaatgcgtccagagtgtggagccctctccgttggcgcagaggtttcagtggtccctgcgaggccttttggggtgtctgccctccctgacctgcgaccaggcatgtcacacggcatccctgccttcaagcactggggtcccctttagagagggtgtgtgagcacccaggtggacccagtgtgagtttttgaagtcatatctggctgtgctgcgagactacttttatcctctccactgtgcttgtccgtaccatgccctgacctcgtgcgggcatgcactcagaatgccagatgtgggcatgtgctcagcgcgcaagccatgttcattacatctcctcatggtgaggagctggacccagggcctcggttagagcacgcttctggtgttgtgtggtttcctgtgtggtttcctcagatggttctcaaacacgctttgatacataatggatggtgttttcggggccctctttcattcccccgtgatttcactggcactgtctgtgagcagcatgtagtgtgaggctgggggtggggggcgtgtggaaaggtggtccggctctgcaggaccctgaatgctccatccagtgtgggcacctgagacgcagcatttgtcaggaactgcataggcacaggggctgggggctcaccttgcactcaggggttgtgatctgagttgggggttggcgctgggaggagagtaggattctgcagctggtgaggccttccctgctcaaagcctgggagtggtcaggagtgctgggtctggatggaaagtgaggttgtgaacaagtcaaggaatttgatgttttcgctagctcttttttttttttttttttttgagacagagtctcactctgtctcccaagctggagtgcagtgacgcgatcttggctcactgcaacctctgtctcctgggtttaagcaatcctctcgcctcagcctcccgagaagctaggattacaggcatgtgccaccatgcctggcaaatttttttgtatttttagtagagatggggtttcaccatgttgcccaggctgggctcgagctcctgacctcaacaatccacccgccttacaggcgtgagccaccgcgcccggcctagctaactcttttaagtagaggtgtgacatttgagttttgaaaagatgatgttggcagcttttgcagaagggaacatcgataaccagttaggtgttttgtttttgttttttgagacggagttttgcttgttgcccaggctagagtgcaatggcgcgacctcagctcactgtgaccttggcctcctgggttcaagcagttcttctcctcagcctcccaaatagctgggattacaggcgcgccaccacacccagctaattttttgttagtagacacggggtttcaccatgttggccaggcttgtcttgaactcctgacctcaggggatccacccacctcggcctcccaaagtgctgggattacaggcgtgagccgctgtgcccagcccaccagttaggtttttaaaagcactggtactgcagtaaaaccacaggtgtatgtcaaaagcctttatgctgggggaaagctgtgccacttgggttgaaggaggcaggcctccagcttctaagtgccctggggcctctgtagagggccatgaggggccacaggatgcagggagctggagctaggccctggtagtcaccatggaggaggagaaacaaggacatccaagacctgaggctggaaggttctggagagaacacaagagaaaaacaactccggagcttccaacctcaagtagggcacagggagacaagcgggtgggaaaaggccacaaatggctccatgtgagtgaggggcagaaagaagaggatgaggtcagtcctctgggggtgtcatctttgaacagcagttgacaggcagtgggtgtgaaggtctatatggcaaggagctacacacgagggaggagagaggtactctgaaaagtttgcagagtgggtaggaaatgactgtggagcagtgaggagagtgatcagtgatggtgtagtagttagagagtgagtggtggtggacttgatggagagtgagtggtggtgctggagtggtggagagtgagtggtgatggtagattggacggagagtgagtgtggtagactcggggacagtgagtggtgatggtagattggatggagagtgagtggtggtaggactgggggagagagagtggtgatggtggtgtaggtggagagtgagtggtgatggtggagttggtagagtgagtgtggtgatggtgttgtgggtggagagtgagtgatggtagtgttgtgggtggacagtgagtggtgatggtggtagactggaggagagtgagtgtggtgatggtgttgtgggtggagagtgagtggcggtgctggagtgggtgatgtagggtcacagaaggaggaaacagcctagaaggtggctgcctttgatggtccttgagtgggcccagctggagaaatggtgagaaggattaggtttctgttgtcttgctcagggactttttattttattgcacttatttgaattaaaatggtaaattcaaatggaatatttgtgtttatactctgttaagtgggagaatgtggagaacaggagtcagctgccatacggccacctggctggctccgggaacctgaggcctggtcttgcccagcaggagcgctggcatagcatggatcacttacagaaatttatgatcaagattatgggctgctcctggcaatatggggaggatttccttgctgtggggactgtctgtttccatgcctggcccacccggtctgtgatagcctcaggtgcagtcctgtcttaagtttggagacaccctgggaggtccgtacagactctttgagtttctgaactgtcctcgaaacatctcaggccctccgcctcagggcctagggaggctgtcctctggttcctgaacagggtggctctgacccgcagatctgtgggctcccgttgcaggtaccggtggtgctcggaaccgtcctcagattcagtcttggaaggtgctttggcacctccttagagtcggacagacccttgtcacgagtcagtccagctgcaggggctcaagttgttctagagctgggctggcagggcccttgggtgagggagtgtggcttggcactggcatctcagcctgcggccaagtttcctgcctgcccaggcagcatgacccttggtgggatcaggcagagctctgcctctcccctccctacctcggaacatcctgtcgtcacacacgattgtccagtgtcatgaaagtttgtaagtgggaaggcaggcagatgatgaattcatcaaacattacagggatgcttttgctgtaagacttcgggatgtagcccgtgtggggctgtttctggggtcccgttcgcctctccaagctcctcctgccattggtaaagatgcagggcatctgaactcgctcttgggctgtgcgggcacttggacctggtcagctccctgtgcagagaacgtggctgtggacgtcactgcccggtattcacgtgccttggttgtgaaagccgttctgtggtgcctgtttgtgtcctgtgagtttatggggaaatcctgaaattgagagctggggaccaagagaactgtgtgcgtcccaccatggaggcgtttgagtgatgctgtcacgaggctctgctaatgccaagaggggaccaatgagctcctctaagggtctaccaccaggtgtccttttacagacctggatggtgaagttcaggcctgaagaggtgaacctgatgcagcaacaaactgctgtttccttcagtgcttgaaggagtgagttctgggaacaggattcagcgactcaggccttcttttgtcctcataaagaaacaactttacatttgaggttaagaaggttgtcagtttagccccctcaggtttaagtgttgaagaaatctatgatgacgtgcttgtttttacaagagtcttttcatatttcaggattttttttttctacataggatgaggttagagaaactctgaagggatattaaaaattagaaaattataggttgggccgggcgcagtggctcacgcctgtaatcccagcactttgggaggccgaggcaggtggatcacaaggtcaggagattgagaccatcctggctaagagggtgaaaccccttctccactaaaaatacaaaaaattagccaggcatggtggtgggcgcctgtagtcccagctactggggaggctgagttaggagaatggcgtgaactcgggaggcggagcttgcagtgagcagagatcacgccactgcactccagcctgggcgacagagcgagactctgtctcaaaaaaaaaaaaaaaaaaaaagaaaaagaaaattataggttaattaaaagttttgcccctgctgggcacggtggctcatgcctgtaatcccggaggccaaggcgggtggatcacctgaggtcaggagttcgagaccagtctggccaacatggcaaaaccctgtctctactaaacatacagaaattagctgggcgtggtggcgggcgcctgtaatcccagctactctcgaggctgagaaggagaatcgcttgaacccgggaggcggaggttgcagtgagccgagatcacgccattgcactccagcctgggtgacaagagcaagacttcatctcaaaaaaaaaaaaaaagaaaaaagttttgcccctaaaacatgctttaaaagaggtattataggaacatctggtataaaattcaaagaataaaaaaggacatcttttttcttacataatcagctctttgttagctctttacttttggtatttggaagaaatctctggagttcgttgtgtaagaattggaaacctcacctttggtgcacagctcgatttgcagtagaagtatcaggtgctctttaggggatgttaaaaacttttcactcttggtatttacattaaaaaatactttgttgtagaacaattagaaaatccagatttgcagttgatatttagcttgacttacagtgtggctttctgctgtttgtcataagagactagatttgtcaagttttgcttagagaggaggactggtagcagcaggtggcttagactacgtgtggggatggatctgcgaggggaagggcagatgtcagcgttggctgaattagaggctgaattaggtgacccctcatcccccaggtgtcttactcagatgattctggttgttcgggtactggccatgcactgctctctgtatctttgtgtgtagcccaagcctggaaaagcatccgccctttgtacctttttcccgactggctgagattcccgcagcatcccgactccgcttcagggctcctgtgaggacagggactatggcttttaagttgtcgcacaggtcatgggcactattcacatgtgctgcaggtaattttgagactcaaggatgaagagttatatctgcctcttcccgttagtcttttatgtgaatcctgtttgtttgtttgtttcgagacggagtttcgttcttgttgcccaggctggagtgcaatggcacgatcttggctcaccacaacctctgtctcccgggttcaagcgattctctgacctcagcctcccaagtagctgggattacaggcatgcgccaccataccctgctaattttttgtatttttagtagagacggggtttcttcatgttgctcaggctggtcttgaactcccgacctcaggtgatccgcccgccttggcctcccagagtgctgggattccaggcgtgagccaccgcgcctggccatgaatcctgtttttctatggtccagtttctaagggattctggtctgatgaatgaaaaccttgtgtgtcccctgtggctttgggatacagtatcttttaacacaggtgcttgccctgtgcaccctggtcttctgttcattaacatcgcgtcactggggtctgaggaaaagagacagtgtgatccgctccagtgaatggggaagcaggagagggtcagaaacctgaatgggtcagcccagaatccagcattgccaacacatccctggccctcccctcctgcccaggtgacaggtgtggcatatgctggtcctcagccctgcccaggagacagttgtggtgtctgtgggtcttcagccctgcccaggtgacaggtgtggtgtgtgctggtcttcagctgtgcccaagagacagttgtggtgtgcacgggtcctcagccctgcccaggtgacaggtgtgctgtgtgctggtcctcagccctgcccaggtgacaggcgtgctgtgtgctggttctcagccctgcccaggtgacaggtgtgctgtgcacgcgtcctcagctatacacaggtgtcaggcgtgatgcgtgtgggtcctcagccctgcccaggtgacaggtgtggtgtgcgcgggtcctcagccctgcccaggtgacaggtgtgctgtgtgtgggtcctcagccctgcccaggtgacaggtgtgctgtgtgtgggtcctcaccctgcccaggtgacaggtgtgctgtgtgctgatcctcagccctgtccaggtgacaggtgtgctgtgcacgcgtcctcagctatacacaggtgtcaggcgtgatgcgtgtgggtcctcagccctgtccaggtgacaggtgtggtgtgcgcaggtcctcagccctgcccaggtgacaggtgtgctgtgtgtgggtcctcaccctgcccaggtgacaggtgtgtgtgcgggtcctcagccctgcccaggtgacaggtgtgctgtgtgctgatcctcagccctgtccaggtgacaggtgtggtgtgcgcgggtcctcagccgtgcccaggtgacaggtgtgctgtgtgtgggtcctcaccctgcccaggtgacaggtgtggtgtgtgcgggtcctcagccgtgcccaggtgacaggtgtgctgtgtgtgggtcctcaccctgcccaggtgacagttgtgctgtgtgcaggtcctcacccacccaggtgacaggtgtggtgtacacgggtcctcagctgtgcccaggtgacaggtgtggtgtacgtgggtcctcagccctgcccaggtgataggtgtggtgtgcgcgggtcctcagccgtgcccaggtgacaggtgtgctgtgcacgcgtcctcagctatacacaggtgtcaggcgtgatgcgtgtgggtcctcagccctgcccaggtgacaggtgtgctgtgtgctgatcctcagccctgtccaggtgacaggtgtggtgtgtgcgggtcctcagccgtgcccaggtgacaggtgtgctgtgtgtgggtcctcaccctgcccaggtgacagttgtgctgtgtgtgggtcctcaccctgcccaggtgacagttgtgctgtgtgcaggtcctcacccacccaggtgacaggtgtggtgtacacgggtcctcagccgtgcccaggtgacaggtgtggtgtacgtgggtcctcagccctgcccaggtgataggtgtggtgtgcgcgggtcctcagccgtgcccaggtgacaggtgtgctgtgtgcaggtcctcacccagccaggtgacaggtgtggtgtacacgggtcctcagccgtgcccaggtgacaggtgtggtgtacgtgggtcctcagccctgtccaggtggcaggtgtcctgtgtgtgggtcctcaccctgcccaggtgacaggtgtgctgtgcacgcgtcctcagctatacacaggtgtcaggcgtgatgcgtgtgggtcctcagccctgcccaggtgacaggtgtgctgtgtgctgatcctcagccctgcccaggtgacaggtgtgctgtgtgctgatcctcagccctgtccaggtgacaggtatggtgtgcgcgggtcctcagccctgcccaggtgacaggtgtgctgtgtgtgggtcctctgccctgcccaggtgataggtgtggtgtgcatgagtcctcagccctgcccaggtgacaggtgtcccgtgtgctggtcctcagctgtgcccaggcttgggctgtgggtgccgcccgttcccagtggacatggaatccttgtgttactgagtgacctgcgtgtgctggttgctgcaccagcgggcttttctgtcgcagttgctttttaattgtatccattaagtagactttccacaagaaaataatatgacttactaaaaaaagttcaagtaatatttcttctgattataagagtaatcttagttgcagaaaatttggaaaaattctaggaaagcaaaaagaagaaaatgaagtcacgttcatatgtgagctgaattgttagggtttcatagcatatgcctgttggatttctatttagccgtgtgtaataaaggcagcttttccaagatgggaatgtgctgtaccttctgtttctaatcttttcacctcagtatattgtcagtgttttctctggtcagttatttttttctaccatgttttcagcagctgtatgtttttggtacgttggggagtcgtagatggtcagttactgaaaaagtgggttaacgtgggagataattaaaaaaaagacgctgtacctaaacacttcattttacattcaaacaaatgtgcatctggtccccaaatctcttggctctggactgaacgccccttcttggagagtgggccaccccttcaagccacgcccaccatactgggttttgatttctgtagactgaatggagaacataaaagacatctcaggacacggagtgcagcctcctgggttgtttgcagttttcccaggatgctgctaacagtgccactggtatagaggggtgtctggaatgagcaaggctgagtctgagacatgtggatctgtccgagagagtcctgtcagcctggtgctttacaggaaaggcggtggagttaggagcgctcttcctgctgcatggatgtgtctcagtaattacccactcccctgtggttggggattctagtggtttccagttaaatcttcccaaatttgcacaaatccaggatgagtcttaggatgaattcctggaggtgaaattgcctgtgcgcgtgcatgtctgtgagtgcagatgctggtcttttcaggtcgctttcagcacagtgtgaggtatagccgtcaggctttttagctgctgtgtagtcatttacttcctctccttgaaagtattaatggcggccgggtgcggtggctcacgcctgtaatcccagcactttgggaggctgaggcgggcggatcacaaggtcaggatatcgagaccatcctggctaacatggtgaaaccccgtctctactaaaaatacaaaaagttagctgggcgtggtggcgggcacctgtagtcccagctacttgggaggctgaggcaggagaatggtgtgaacccaggaggcggagcttgcagtgagccaagatggcgccgctgcactcccgcctgggcgacagagtgagactccgtctcaaaaaaaaaaagtattaatggctcggagtaacttgtatgggacttattttaggctccactatttcttttgcctttaagaaaaatcaaggcttgaatgaaaatatttcgtgtcaccactattgatagaacccaaattatattttgcagggaagcaggatgaagagggagatgaccgtggtgggagttcagcctctgactttgttttcatgcctgagtttgaggtcatatgtcttacccagttattgactcttggaggccattcctgctttagggcatcctttgactccgggagtcgtttttaagctgaggggccttatctggaacgatgcagcatggaggacagatgtctgcctcggtgtcatcccggtagcccgagttgagctggctgtggatgaggggttcctcttgcttcaggagaccctgggtgtcccctccccagcacggccaggttggggaggaggagtcacacatttgacagctcacggggtgtgcagccacagaactggaagcctggtctgtaggctccgtgtctgggagctcttcaggccagcggtggagtcggctagccacgatgacttttgcccggacttaacctcttttttctctaacaaatggaaaagcagttcccattggagtggccagaccaaatcctattctggggtggaaggggatgaaggtggtcagcatcgaggttgatcttgatgccagtccccatcccaggctgtggttccagtggcatttatcacatgtggatgctgatcctggaagccctgcttcgtgtttttgggcatttgttccctggagccctgtttttgctcactgttgagacagaaaggctgcgcgtcccctcgccccagcctgtcctgagcttgcctcactgtgcatccttgtgggtgggcgtcaaaccccgcacctgagtctgctgcggctctggtgcctgcccggcgccattgtcagggtgggtgtcctgggccctctggataccccctgtctggccggggttgccgctccgttctgaccccaggccaccctggaggagggtttctgagagtgccggtggctcactctgtccttggatgacttgatttttgttaaaatggaaatggaaattctttctaaaagggaaaagagtataatgtaaaaacttttccagaagagaaattagattaacatattgttatttttaaagttagctgctatgataaataaatagatgaatggagatggtctccacctcccacaggctggcggtatactcgggcgagggctatggggcggctcttccctgaggccccaggcctggaccccgtcgcgctgtctggcagcgtgtgctgcatttccctctggaggattttcccaccggaacctgtgtgatgtgttgtggaggaagctgtgtgaggcaggggtcccggggcctgaacggctggaccttgctagccctgcgacctcaggtggggactcctggcctctgtgtgctcgcctgtcccacgtgggcggccagctgccctccctacagggcagtgagggagaaaggagggcgtcagctgcttgccacgtcctggctgaacttggatggattcaaaagagtgaacataaggctttgacgaaattaggagcacctcacaggcctgggcgctgtgtaagacctcctcccagccacgaggggctgatctgatcagagctggagggacggccattgccgtgtgtccaatgtgagggctctgagctcaggagccagcatccagacacgctggggactctgcggcctctgtctttgccccagtgttgcacagaggggccctggctttccctgggcactgtttagaatgattgagggggtggcaggtggccagaaacgggagaggtggagtctccgaggcagcaggcctcccctgcaggctgctgcttccaggagggctgcaggcacgaggtgttcaaatgcagcagtgacttcataagaaaagggagtggagccgccgacatttcaggtgagttgtcatcaagagtgcagaatccaactgtgttgggagccacttgctggtgcctggccaagttcccgtctggtccctctactccccaccaccccagccctggaaaaccgtgcctgccaggttcataccacacaacccggtgcagcccaccccaaagacagcgggaggcaggatgcaagcacctttttaacggctgtggaactgatgtatgggttttccaggcagttttgcatttgtgcctgttgtagactagagcatcatttggtgtttttctgctggaaaagcaggctttagagtggtggctgaaagtctcattatagattatatagattagagcagcctctcctgggagagggatgctgggtgcctgccttccaagtgtctgctcatgagtggatgggccccaccctctgtgcctgctggggcttcagaatccactggtttcctgaaggttctggtgcccccgaagcacagccccacctccctaacctgccctcctgtgactcccattgtgtatgaacttacctcctcgctcttcagcttcccctgcctgatggctccaggctgtcccctgaggacctggggttcgtgttgccctcctgggtggagtctgcgtccccctttcctggtcatttaagttgcgtggggccgggaggaggcgttctctgcccctacgtggctcacactgtggttctgtggccgccgtccctctgtccgctcggggtagccagcttcctctgactctttcttagggtgatgttgggcaccaccctcgcctgcagctcatcacctctggatggatcttgttaggtgtgtggcttttcccttagtttagaaaatgaaatcgccttattgctttgttcggttatgaaaatggaaagtttatttaaaaacgtagggtgcagaaaggtgtcagaaagtaagcagtcatctgaaatgacagtcaacggggctctgctgttaaggctttttggtgattgtttctggggatgccctagatgtgtgtgtttaaatacacatgtacagtacggaattctaaataaatgaactcacatgttttgttcactgctatgttttactcaacagtttgtcctaggtttttttttttcacatcaataaatataagcagagataattctaaaaaatttgtggaacgtttcagacacacacaaaggagagagattgtgctggtgcctcgtccctgtcacggacctgggtgactccctgccgggccagggtgatcattaagtagttattaaatattctgacatgtgtctctcagagatagtcattcactcttattgtcacataggcagcatttacatttctcaagttgtctcaaatttggaaagtttgtttgcattggagcctcgccccctccaggctgctggagtctggtctcgctgatgcgccctcacgtactccaccctgttgatgggctgccctggctgaatgttcatccttcgaaaccctcaaaggtgttgggtgttggggcctttgggagtgactagaattgagtgagggcacgcgggtgtagtcccccctgccctgttggatcagtgtcctgatagccagtccccacggcgagcctgcccttttcccaccttgcgaggcccaaggaggaggtagtaggtgcagcctggaagctggctctgccctgacctcccgcttccacatccaggaccgtgagagagaatccttgcacttagggctccaggactacgagagagaacccaggaccgtgagagagaacccaggaccatgagaaagaacccaggaccgtgaaagagaacccttgtgcttagggcttcaggactgccagagagaatccttgtatgtagggctccagaaccgtgagagagaacccaggactgtgataaagaatccttgcacgtagggctccaggaccatgagagagagcccaggaccgtgagagagaatccttgtatgtagggctccagaaccgtgagagagaacccaggactgtgagagagaatccttgcacgtagggctccaggaccatgagagagaacccaggaccgtgagagagaatccttgtatgtagggctccagagccgtgagagagaacccaggaccgtgagagagaatccttgcacgtagggctccaggaccgtgagagagaaccctcgtgcttagggctccaggaccatgagagagaaccctcacacatagggctccaggaccgcgatagagaactcaggaccgtgagagagaacccttgcacgtagggctccaggaccatgagagagaaccctcacacatagggctccaggaccgcgatagagaacccaggaccgtaagcgagaatccttgcacttagggctccaggactgtgagagagaacccttgcacatagggctccaggactgcaagagagaacccagaaccatgagagagaatccttgtacgtagggctccaggaccatgagacagaaccctcacgtggggatccaggaccgcgatagagaactcaggactgcaagagagaacccaggacccaggaccgtgagagagaatcctcgcacgtggggctccaggaccataagagagaacccttacacgtagagctccaggaccgtgatagagaactcaggatggtgagagagaatccttgcatgtagggctccaggaccatgagagagaaccctcacgtagggctccaggaccgcgatagagaacccaggaccgtgagagagaatccttgcacgtagggctacaggaccgtgagagacaaccctcacacgtagaactccaggaccgtgatagagaactcaggactgcaagagagaacccaggacccagaaccgtgagagagaatcctcgcacgtggggctccaggaccatgagacagaagccttgcacgtagggctccaggaccacgagagagaaccctcctgctcttcccacttgatgcttttgctcactcggagcgtgtttgtgagatgagccttcacgctgtcctggatcttctccagatgcgaggttcttttctgctgcatccctcctctgtggtggcaccatctcctcttgcctgaggtggggaggtgttggcctccgtagctgagaagggctgggcctggcggtcacccagcgtctcctgcctggacttagcaacttgaaccagcagcgtctgtcacctcctagtgcctgttaggagcccaggtccccgttcagcctgtcccgggcggccctggcctgtggtgccctgagttggtctgggcaggaccactttcaaattaactcacccggctgctggtgggatcccgctccttgtgggctgttggtgggggtgtgttcttgcactttgccttgtgggcccctgcgtagggcagctcgctggtggcttcctcagggtgagccagcaaggtcagagtcggtctcttgaggccaccctcaccctcaccaggctctggtgcttggtgggagcagggcagggcagcccacttgggggcccctgcagggccagggcactggaagggatggctagggccaccggaggtcgtccctgagctctggggttgtgtttgttcccaggtgtgctctccagggtccaggaggactcgtgggagctcgaggctggggtcccaggcccggccccagaggaagggcctgtggccaggtgcgcggaaggtgctggctatttgtggtgggcaacccaacagccaaaagggaggagcagagagagttctccgcaggagttgatgggggagcagacagagttacccgcaggagttgagggaggagcggatggagttacctgcaggagtcgagggaggagcggagagagctactccctctgtagctctgagaggaggacagagctactccctctgtagctctgagaggaggacagagctactccctctgtagccctgtagcggacagaggagggacggagctacccgcaggagtcgagggaggagcggacagagttacctgaaggagttcagggaggagtggatggagttacccacagcagtcgagggagaagcggatggagttacccgcaggagtcgagggaggagtggacagagttacccgcaggagttgagggaggagtggacggagttacccacaggagtcgagggaggagtggacggagttacccgcaggagctgagggaggagcggacggagttacctgcaggagtcgagggaggagtggactgagttacctgcaggagtcgagggaggagtggacagagttacccgcaggagttgagggaggagtggatggagttacctgcaggagtcgagaggggagcggatggagttctccgcacgagtcaaaggaggagcggagagagttctgtgcaggagtcccgtgctggggccaggagggtcctggtagcaggcggggcccatcccagctgctgtttatagagtggcctcttccccaggtctcttcattcattatgcagtttaatgtgcagtgcaagtgttttctgccctggggtctggcgcaggccactccagtcctcagggggatccctcagtgcagctgggtcactttcttctcagctctgcttacttttgaaattaagattgttccttgacacttttatggctgttgcgtaggcagagttgagtggctgtgacagagactgggtgaccctcaagcctgaatcatttgcagggtcccccctgagaagtgtgcggccctggcgtccctctctccagccctgccctgggcctggcttgtgaacctgtgatgtcgggactgcagggcccctgctgggccgttttcttaccaggcaaaattcctgcttcacagagttgatgccaggggtgtcaaatcttttgttttccctgggccacattggaagaagaattgtcttgggccacataaaatagaataacactaacaatagttgagctaaaaaaaaaaaaaaaacgtataatttacaaatttgtgttgggctgcatgcagaggtgtcctggaccacatgcagcctgcaggacacaggtcggataagcctggtttatactctagtggggagctgttagcaatggaaatggtcagttgttcagtagattagaaagtgcagagaagagcagggcagagaagggtgagacagcgtggggtccaggtgtatgccccacctggctgctgtgtgttgcttgctgaccccctcatgggccttcgagtgtaagggagagtcctcttcatgccctcgcaccctcctgggtctctagggcttgtgtgtccccaggggaggagccccctggacacaccctggcgggtgctggctggcaaagagggaggcgttgagggcccgggcagcgcctccatcctggccaggcaagtgcagcttcaggttgtgagaaccgtggtcacctgtgtgttttaaagatgacggcagtgataggtccccttttgggcctggcatggaaattagtcacattcgtagaccctgtcacagagtgggcactggtgatgtcatcttttatagttcttattttcaattgattcagctttttctagcagcatggcgtgttttacgaacgtgtgttttgctgttactgctgctactcatagtatggttttgtctaatgtaagacagaagagaataatctactgttatctccatgaagtacaaacacaaatacagttgaatatagtttttctaatagaaattaaggttagttttagccaaggagcacctttgctgttggcttatatgttaatgtgtttagcaccttgaggtgtccttactggcaggtagggttgcatcttgagtgtaaagatttaacaggaaaataagtccagtgcacatgtcttaaaattaatagcaatttcagcaatatgttaaaaacacgaagctaggccaggcgtggtagcttacacctgcttgagcccaggagttcgagaccagcctgggcagcgtaatgagacctcgtctctactacaaataaaaaaaaattagccaggcatggggtgcatgcctgtcccagctactttggaggctgaggtgaaaggatggcttgaaccgggaaggtcaaggctgcagtgagctgagatcttaccactgcaccctagcatgggtgacagagtaacagcctgtctcaaaaaaaaaaaaaaaaaaggcaaattaaactatttgtgttttggtggtgcttgttactgagttcctgtgggtcacagcccacaagaaatgcaaggaggacccacatgagggtctttcctacagctccttacatgctcaagctggtaattgtggtctagtagtagctactgaatatcaacccataagaatgacttcatattaaaaaaccacagaggctataattgggtctgtcttagtaagttctaaagtgtcagtagagacccagactcacacccacactcctaagggcaggacacaggggaggctgtggccttggatcctgtgtggctgaaatggggttgcctattcaggtgctgagtttgagatgggagctggcccctggcctggagagtggggacttgtgccgaggccactttgctgttgcccagcaggccagcgtgcaccccttgcgcatcctgttgacacgagcactgagcggacagacctcggctgtcctgttaacaggtcccacttagcagcctccgtttacagccagcccgggacctgcctggcaggacccctggtagttctgtgtcataggagcccctctttgttccaggccaaccaggacaggcggtcaccccacatacagggttctgaacgttctgacgttacagcgggggtctggtgctgttgtctcaggcaggaatggaggctgagggtctgcacgtttactgctgtgtgcaggccccgtcccaggagcgaggtggagcccatgtgaggaggttgtggtctttgtaaaggtgagcagcagcgagtcatgaactgcaagctcttggtaggttttggacgggacgtggctggctgagcttcctcttggctgtgtggagcctcagcagggcgttgtgtttgacggcaaatgggaattaaatcatggcatcgtcactgtcttttttagggacgatgctgcacttagttcttgcgactcttcctgttgtcagttggggcgggggggcgtcataacattctttcctgtccttgggggtcaccttccaggaaaggggtgggtgtcagagagtgagtgtggctttgaaaggctggtgttgagtgggatctcgtttttcaggtgatggtgccagtgatctttccgtgcggaactaagtttatgcagggttcaagatccattcaaagataaattcagtgacgacctggttgatgaaaagaaccacttttttttaatgttctagagaaaactctttaactgctgtattacttatctattgctgtgaaacagacaaatgtagtggcttaaaacaacaataagctgtcttctcccacacagcggctgtgggtcaggagtttgggagtggctcaattgggtgctgctgtcctggattctcatgcagttgcagttgagatgttgcccagctctgcaggcctcaaggccagggtctgggagtctgcttccaagatgtctcaccctcgcagcagtagcaggaggagccctcagcaccaggaccacctcagggccgcttgagtatcctcacaccgtggcaccagctttcgccagagggcagggagtgacctagcttcagaagttgccccttatttccatcctcctgggggtcacagaagtcagttcagggaggagaaggtggcacggtggtgagtgtctgcaggggatcctgtgggaaagcagcgcagtggtgagtgtccgcaggggatcctgtgggaaggcggtgcggtgatgagtgtccaaggcggcgcggtgatgagtgtccataggggatcctgtgggaaggcggcgcggtggtgagtgtccgcaggggatcctgtgggaaggcggcgtggtggtgagtgtccgcaggggatcctgtgggaaggcggcgcggtgatgagtgtccgcaggggatcctgtgggaaggcggtgcggtgatgagtgtccataggggatcctgtgggaaggcggcgtggtggtgagtgtctgcaggggatcctgtgggaaggcggcgcggtgatgagtgtccgcaggggatcctgtgggaaggcggtgcggtggttgagtgtccgcaggggagcctgttggaaggccgcgtggtggtgagtgtccgcaggggagcctgttctggttgcttgggctgctgtcacaagaatgccatgaccatgaactgggcagcttgtaaacaacaggaatccaccgctcacagctcgggagcctgggagtccaccatcaaggccctggtaggtttggtgtccagtgagaaccacttcttggctggtaaatagcgtcttcttgccgtgccctctcctggtggaagggccagggagcccctttatcagggcacatactccatccaggaggctgtgccttcatggcccagtcacttccaaataccgtcccaagcaggattaggaggaccacatgtgaagacgccgcacagccttcctggaggctgtgtgccccagccctgccatcagctgcctgctcccgctcacgtctccccagttcacctgcctccagtgctggtttatagaacatttgtgtgacttcttcagatgatctgtaaacagaggcagtctaggtggtgttttgttttctaatttcctttatggaaaggagagtttgcatttcccttgtgattttgacacacattgtattatgaaatattttcagtgtttgtcaaactcggtgtggggtaagcgcatcccaccaagataggcgcttacaggcagccaaggaacccaccgtgtggtttccttttaggttggatttcctgtcttacagcctcatgttcctagttggaaattaaggttgagactgtagccaggtgtgcatttattcatccgccagctctggagaggtctgctttagaggccctgcggccccagaagtcatgcctctgagtccgtggttcttagctgagggtggctttgcagtgtccggagatgattctggttgtcccacccagggtgaatgaaggctgaagatgccgccaaacaccctgcagggaggctggcccctgacagagccgtgcaggcggcagcggcagcactgttgctgcggctgagacagcgcagggcgtcattcatccccctgcctcctgagcccagagcttctccaggagaaagctgaggaaaggggccagccgtgagctgcgggtgcttgccagggatctggtgacacctgggcatgtggctggtggaaccagcaggccaaggctgtggattttgaagtgctgtctgccatttccactttcagaagcatgagttgcataaggaaggggaatgaaagggtttttcctggagcaaaatgatgcttgtggcagacacagttggaaccacagacgatgccacgcttgtgtcagcagtgcgacactggcccacgtgtcgtccttgttctctcctcattgctgccgtcactgtgtgctgcgcatgccctgcagttaccccagagctttatgtcacaacattgaggctggcggagaaagaccggccccttcaccccaccttagacttcctggaagggccgcccgggtccacaacctggcccgttaactccctgggcagctgctggggaggaagaagcactgcccgcaaggaggggctgtgccagtgggtggcggtgacgggggccagtggtttcctggacctgggtttcctgggtgtgggctactcagggattgctgagttcccatcccagccggagctgaccaccaagtcgacggggcagagtgagaaacatccaggccacctgtgccgcagcccccatggctgccgaggtctcccctgggcaggggcagttggtgttctcgcagggcctgtgttggtgcatatgaggagtgttttctgtgagcagcggtggaacatttacagacacgagcgtcacagtggctgggcaaggcccgtggctgagtgcacggtggccctgggcggggctcctctgttggggcctgacttgctggcatttcatggaggccgcaggcagccgctcttcctgggggtcttccacatgccctgcaggcatggggaggagcagcccccactctgtctctgcccatcaggctgcccccgccaacagaaaaaaggcactgtgccacccggggcagtgcgttcccagtgccagtccctggccctgtactttttagcaggcgctcatgctcatcctggtgagggagggcgatagacagggacagcggtgcaaaatggcttcagagcctgaaccacggttgccacaggctggggctggagtgcagacaccatacaggggaactgggcagagccctggctgtgcaggcgggagggcagtcatcctccacagctgggacttgctccgtcagacccccagcagggcttcctccagctccacgcacacggggctggagcatgctgcactcccacacagatgctcgagctgggcccaagcctgaccagccctggccgaggcccttgactcctggcctcacccaccacgccttaacctcctggctgtaacttcctggccttacccttctggccttacgcacctggctgttctctcctggctgacccaccttgtgtttaacttctcggtcttacccagtgtgcttgctttcacctccttggtcatagtcacctgaccttaacctactttgctgtagtgtcttggccttcatctcctgtgggttctagcccaccatagccacttggccgtgtgtacctggctcagccacctgtccagacccactcgcctttttctaactggccgtaccctcctgccctttctctcccaggcttaacgtctcggccttaccaacctggcctggatggtagtgccctcatggtgaccaggacatctagcgtctcacacctgtaacacactaatgggtgccagcacagagccacgcatgccggccttcaggcaccatcgttgaccgcacgtcatgcttttcctggtgtcgtatgtttgtgccagcgtagccctctgcggggcctgtgccggtgctgtgtcaggtgtggtggcctcagagcgcctcctgggtgcagtcaggttcttgctccacggctcttttccttgatattgcgtcacacgccgtctgtgggcccctgggggtggtggagccttgatcccagccccttggtgtggccagtgggatgcagcccccctgcacatcctacctcacctggctctgtgtgcaggtggtcaatgggacatccacccacctcccagcaagtcccacagccagggctgggacggtgcctgctggacagctagactcagaaagtgcagttggacccggttggaacggcagtagtgactgtcttttttttttagcgtcctaggatgtgaacttgccgtggtcctcgggcttacgggcagccctggctttcctcatcttctgtggggaagtggagttgtgaagatgcccaggaaattgcccagtggtcttgcagtggtcgtcttgctgggctttgagtcttggctgcctcccctgtgtcccctgactgttacctgggtggcaccagggggtcttggcgtctccttgttcccatggtgtgtcccctgactgttacctgggtggcaccagggggttgtggcgtctccttgttcccatggtgttatctacggaagggtgcattcgggtgcctttaccctcagcgaaggcagcaaccctcatcgctgccccccagccccactgcctgaggtgcgtggcctcctgggaccctgggtactcaagcatgctgccgtgtgtgtgctcacactcaggctgccacgcctgtgctgccagcacgccactcccagaggccgcccctccaaggcctcctcttgggatggcttttccttcgcagagcccggcctctggggactgacattttgttgggactaggaagagaataaaagatttccatggctttctggagaagcaggatgaggttgacagttctgataggagtcccccttaatgtgtcttgccgtgtggctgtaccattacgcgtgtgctcttgccgtgtggctgtactgtcatgtgtgtgcccctgctgtgtggctatactgtcatgtgtgtgcccctgctgtgtggctgtaccgttatgcgtgtgtgtcctgtgtggctgtagcatcactcatgtgcctctgccatgtggctgtaccatcacgtttgtgtgtgcttgctgtgtggctgtactgtcacgtgtgtgccctgacgtgtgactgtactgtcatgcgtgtgcccccaccgtgtgctgtaccatcacacgtgtgaccccgctgtgtggttgtgccatcatacgtgcccccactttgtggctgtgccatcacacatgtgcccccgctgtgtggctgtgccatcacgtgtgcccccgctgtgtggttgtgccatcacgtgtgcccccgctgtgtggttgtgccatcatacgtgcccctgctttgtggctgtgccatcacacatgtgcccccgctgtgtggctgtgccgtcacgtgtgtacccctgctttgtggctgtgccgtcacacgtgtgtccttgctgtgtggctgtactcttacctgtgccacacttaaatagaatgtgtttaacattctattgtgaacattttcctcatcattacaatcttgatttttcaagactgtgtggattctgtaagtcatggctaattcctggtggacggtgctgttttggccctgtaggtgccatggtgatagtgacattccttctccggacctggcgttctcctggttgttcctggagttgcttgcttaactgtggtccttctgcctttttatgacgttatttgatagaacccttgagggtggttttaaacacccctagtttcgtagcccttttagctgtcatatttattattgttttgttgctttccgcaggccggtctaattgaagccaacggagaactcaaggtcttcatagaccagaaccttagtcccgggaaaggtaagggcacctgttctggacacactcttgtgttgatgaatgcatgaagcttcacatgtttatgaagctgttgacgctgaagcctcttgctaatgatggcatctcctgcatgggcacctttgtgctccgggaacccaggagggtgggcgtaggagccttctagcatttagaacacagcctgcacacacaccagtagctttgtggattttgaattctaaggtatgtatactatttgcaaaagtttagaaaaggtagaatattgtaaagaagaaataaagatagtttgttttctctccacccaaagataatgacgtttcagctgtggtgtgggctcttccagaggccggcctcacctgtgctgtttgaggaaagatgggcctaccatggtgcatgccttctgcgaagcaggcacttgccacctttaacgcttcgcgtgtgtattttactagctcttgaggaagagccgtttttcttgtcttggggaatccaggggaggaagtcagctggagaggttgaagccacctcttccagggtcccacggttggtagtttccattttacacctcggagtggtgctgtggtttacgttcgtgaaggtgtgtgtgctcacctggttacttcctgggtaaactccttacctgtgctgggtcagggcacgccatttagaagctttgatgtgcgatgcttggcccctcgtgagaggctgtgctgtgtggatctgggattgcgtgcagggtagttcgttgtggtttgttgcgatattcctgggagacaagcttgtggaagagcttgctttgtcccaagacctgtctgcctgcagagcctagtgggtccactgagtgccctggtcgcaacatccacgtggtcgcatcagcccagggaggagcccagaggcctggatgtgtttccgttttgggttcctaaaaggaaccttaagatttttctaattattcccatatataaaattagctttttttactcttaacattgtgacccttgtaagtgacctctcagtgcttgccatggctctggggcgtgggagtgtggtgaccaggcccccacctctctgctgaggcttggccttgccacccgtccctttctgtccagtgctggtgcgggcgcccatggtgccatctgcctccaacccctacatgctgtggatccaggtgtctccttggggcctgtccctaggtcctgctctggtctcttccttgagagaacttggctttgtgacctgagccagcctgcagcctccccagcctcctgctgtccccgggccctgtcagagggaggtggtgggactggccctgctcttctgctgaagcaggtccttccctgccgcttttctaggaatagggaccaaatctacgcagcccttttgggattatttatgagctttttgtcttgatcatttgaggattcacagattgcttgagagaaatatcgttttagtgtaactaattgaacacttaaaagtggacaagttgcaggcgtgacattttctgttcaagtggtgaagcagaaataacaataaaaaagttcaccattttatttgcttggaaatgatgaagtctgttactatggtgttgaatttgaatttctcttgttaggttacatgcagtaggctttcttaccacatgtgggctgtctccttttccattcttactcacaaatctgtgcttgaatctgtaacaagtttaattgagctgaagagttgaattgcagggattaggaaggaacatattctgcattcatgacatagctgaaaatgttctggttttgagccggcccagcagggccgtgcatttcccctcagctcgccccgcgtgccccggcccccagatccctcccacatgagccttgggacggtcagttctttccctggatcgccggcagcagctcctggacctcccctgccctcacctggtgttgattccaccgcacagacggtggtttttgttgttgttgttttggagatggagtctcactctgtcgcccaggctggagtgcagtggcgccgtctcggctcactgcaacctctgcctcccggattcaagcgattctcctgcctcagcctccagagtagctgggattagaggtgcccaccaccatatccagctaattttgtatttttagtagagatggggtttcaccatgttggtcagactggtttcgaactcctgacatcatgatccgcccaccttggcctcccaaagtgctgggattacaggcgggagccactgcacccggccacacgtggttattttaaatttgcttttgaatcagtgacacgttcatgtttttaaattttgaagtatgaaaaggtgcagagaggtttccttttttcctcttctgtccatgcaggtgagcaccaatgttcacttccggtgttcgttccagagaattctgtttaacaaatagaatggtttgttggtgtttgcatgtgtctgtgtcaatatgtgtgcatgagtgtgtgtgaggaatgtgtgtgtcactgagtgtgcatacgagtgtgtgtgtgcatgagtgtgtgtgtgtatgcgtgaatgcgtgggtatgtgaggagtgtgtgtgcatgtgtgtctgcgtgaatgcgtgggtatgagtgtgtgtgtgcatgagtgtgtgtgtgtatgcgtgaatgcgtgggtatgtgaggagtgtgtgcatgagtgtgtctgtgtgtatgcgtgaatgcgtgggtgtgtgaggagtgcttatcagtgcattgtgcgtgtggagtgtctgtgcgtgtctgttcatgggttgcatatgtgttgagtgtgcatgtgtgttgagtgtgcatgagttgtgtgagtggatgtgagtgtacctgtgagtttgcgtgtgtgtgcatgcgtgtgagttgtgtgcgtgtgtgtgcatgtgaattgtgaggagtgcatatggagtgcatgtgttgtgagtgtgcatgagttcacgtgagttgtgtcagttgtgtgcgtgcgtttgtgagttgtgtgtgagatgtgtgttgtgtgcatgagttgtgtgcatgagatgtatgtgagttgtgtgcatatgcacgtgtgagttgagttgtgtgcatggagtgttatgtgcgtgtgcatgtgtgtgtgttgtgtgcatgagttgaatgagttgtatgtgtgtgttgtgtgcgagttgagtatgatgtgtgtgcgtgtgtgagttgagtgtgagttctgattgtgcgtgtgtgtgagttgtgtgtgtgtaagcgtgcagtcctcgcctccccaacagacacctgtcttcactagtgggccccccttgcctctagttgggagtggggtggtccaggcagggtcctcggcgcccttagatggagccgttgcagctgctttttgagttgccctcggcggtgccagtgagcaaggctctgccttcctccgtttgtgccctgggagcccagggcatggtcggtagcactttgagggctgtagaggcctcccttgagtcagaccttgaggaaggacaggagctgtccaggtgagagtggatcaggggaaggtagaggggaccagcccagccgaggctcctcatgggcccctggccctggtcctggtcctcccagctccactccacgtcacagcctcccggggccactgtgtctcttcctgctgctgctgtggggggcctgtgtccagttccccactgtgtcagcgttctctaaagtagcagccagtgagcgacgggaacctgggtggggactcactacaggacccacctagccatagtggggccgtcagggcggaacctgcagggtggttggtggtgaattccttttctgggaaaatgcaggtgttgctctgaaagccttcagtgggttagacgaggcccacctgcatcgagcacagtctcctttgcttaacggctcctctttgaggagctccgcggcaagttctcggctggcctttggctgaataatggatagagcaccgtcaggttgacacgtaaaactgactgtcacacccttcgaggcttagaaggctgctttccacccagagaaatgcaccaaactcgagacattttgcatccacaggctccccaaggatgggagtcccaatgtggaggtttggcaatacatcttacgtgggccattttagttgtggctgtttgggttgcctctgattgtttcctgagagcaaaatgctggtgtgaacatttgcacacacactttgtgtgtctggcagttccacttcctcaccagcatttggtagtggtgggtttttaggctttctgtgtcacaggtgggctcttactcatatcatgcctacggccccgcagtgctgataggagcttttcctctcgctttgcctggtccaccctgcccctgtctgagggtgacctggccccatggctgcctgcactctcctccctgatgtgtgcaatcctgcccggcctgtgcctcgtcctcagggaggccatccgggaggccacagctggcctggaagtgtgcttgtctgtctctacctcagggctgcttgtgcacctcctgtacctagaggtgatccaggctcactgagaatctgcccacactgttccacacgtttaggccaggtgcaggggctcacaccagaaatcccggtgctttgggagactgcagtgggaggattgcttgaggccaggagttcaagaccagtctgggcaacaacgggagaccccatctctataaaaaattttaaaaaaaagtagccaagcatggtggcgcatgtctatagatagtcccagctacttgggaggctggggcaggaggatcgcttgagcctgggaggtcgaggctgcagtgagttgtgattgtgccactgcactccagcctgagtgacagagccagaccctgtctcaaaatgagtaggctgggcatggtggctcaagcctgtatcccagcactttgggaggccgaggcaggtgtatcacctgaggtcaggagctcaagaccagcctagccaacatgatgaaaccacctctccactaaaaatataaaaattagtggggcgctgtggtacacgcctgtaatcccagctactcaggaggctgaggcaggagaatcacttgaaccctgtaggcggaggttgcagtgagctgagattgctccactgcactctagcctgggtgacagagtgagactctgtctccaaaaaaaaaaaaaaaaagagtaagtgtgtaagtgtacatttgagcgtgcactttcgcagctggtgcgtggagtgtctgtcctctccatgccgtgtggtggctcctgtctgtagtcactgggacccttccagtcacggtttcggtggctgcgttttgctaccttttgttatttgctgccgttttctcgtagagtgctcatgatttttaacatagtaaatccgtggagagcgctcaggtacagatcatggctgtgtgcagtgcaggctcaccgtctgcggcgccaggccgggtccctcgtttgctgctcatctgggagtgcccagcacatgtggccattgattatacatatcctcttagcccagaatgactgcttactaaagagcatctccctttgttgtgtctttactttcctcctgcttcaatctcatatctgtcggctttagggttctaagtggaggaggaaatttagcaatgatgtgtggtcagaagcttagtgttgcttacgtaattcctcactcgtgaccgtcgcctgtgaactaactgtgccccttgccccccgacacacgcactggtctttgtagagctgttaggaagggggttataggaagggagggtataagttttggttggcctcttcaaactgccagcctcctacaaaactgtcaggagaggccatcagctttttctctctttgtatttctctgtttttaacccgaaggatgttaaaagcccagcctctgtttttagcccagtcatgacatttctgtggccgtaacccttgttccaggtgtgagatggtgactcttggatgcagggtagcctcccagagctttgtgtgtttgtatagagaggtttgtgggagtgacttgagccgtgctgtgaacttggactagcacccgtgtgttctcaggagcgggtcctgctggaggcccagccacgtcaggcacagtaggtgtgtgatttgtgcaacggaggcctctgataactgccagagtagatagcttttgtgtgggagctgcctcagcctgcattccaggagctcaggtttcctgagtctgaatggagtctggagagagcaatgtctccatggagcgggtgcctggctgtggtcgcttaggcaggagcttcctcctcagtgctgacaacagagaagaacattctgttgtggccagtcaagtgtgcacaaatgctgcttgcgagccagtcacagaggcactcacatgcagagccgctcacctgcagagccgctcacctgcagaaccgttcacctgcagagcccttcacctgcagaaccgttcacctgcagagcccttcacctgcagaaccattcacctgcagagccgctcacctgcagaacccttcacctgcagagccgctcacctgcagagcccttcacctgcagaacccttcacctgcagagccgctcacctgcagagccgctcacctgcagagccgctcacctgcagagccgctcacctgcagagctgctcacctgcagaggggttgtgcttggccagataagcaaacaaaacatctccagcatggtgggcaaaatagtaactcttagacatctggctctgacaacgtaaagatgttaaaattgtttttcagaaaatacaaaactgtatggtttcataatttatcttaagccctatagatattaatagaataggattagtaatgataaaaacgtgaatactatatttagactcctttttctgttaatggattatagcaactgagaccatatatattcttaactagttttcttcccaagaaaggaattctccatttaaaatgctgtatataaaatgtttttaattagttcatttgaaaaacgctgtgtagtgccttttacagttgaaacaatattatttctattgagttggcttgtgggccatgtcttcatgtgactcagcttgtccctgaaatgttagccctcctccctcccatgcatagattgtgtggcagtcttatcaagaaaatgtgtggaacactctactctacttatattgccagattaaaactaaatgattggctgggcgtggtggctcacacctgtagtcccagcactttgagaggccaaggcgggtggatcgcttgaactcaggagttcaagaccagtctgggtgatgtggcgaaactctgtctctacaaaaaatacaaaaattagccgggtatggttgtgcgagcctgtagtaccagctacttgggaggctgaggtgggaggatcccttgaaccgggaggtggaggttgcagtgagctgagattctacaactgcactccagcctgggtgacagagtgagaccctgtctcaaaaacaacaactactactactaattgaaataacattctatcctgaggtggacaaaaaaagtggtggggagcggcagcctggctgccactggtgcgtctggcctggaatgaccacttggggagctgggtggactctgggacagcggccgctgggacccgggcttccctggtggcaggtgtgccgaggaaaacacacagcatgtggttcagtaataacaaacagcattttcatatgacatctgtgttcatatgaccactttattataatggcatagcataacagcatttaaggaaatcagcctgacggctctatgtatgggtaaatctgaaacacaatgttggcagaattgcagaatgcgagccatataatatttgtctgtgtttcagacgcacacaaaaacaatcatttatagccttaggttcagcacatcctggaaaagtatgaaaaataaagtgagtacgtccctgcaggccctgggagttgcacacagggcagactcggggggaggctgaggatcctggggactgtaattttatttctgctctttatgtctctatgaaacttgaagcaagtatgatgataacagtgaattttaagtgtactggaataaaattgtcatgttattgtttgtatttgaaaagtttctcagtgaatagaaacaagaagcccggctgggcgtagtggctaacacctgtaatcccagcactttgggaggccgaggcaggcggatcaccagaggtcaggcgttcaagaccagcctggccaacatggtgaaacccttctctactaaaaatacaaaagttagccagtgtggtggcaggtgcctgtagtcccagctactcaggaggctgaggcaggggaatcgctggaacgcgggaggcggagcttgcagtgagccgagatcatgtcactgccctccagcctgggcgacacagtgagactccatctcaaaaaaaaaacaaaaaaaaaaaaaaaaaaagaagaagcccacccacccaggtctggccccagaagccactgccactgccctttccagcctgtacgtctgggtgtgggtctgagatgtattcagggaggggccttgctgctcgctgtggtcgggtggctgtgcaagctcagcccctatctccaggcccttctgaagtgctgctcggggccggacagggggtattcaccctcagcctcaggatttctttcttctccctgttactgatgtacgtaccctgccctctgtcccgtagagactcagctggtgacccaggggtgctgctgggttggtgtggtgtgccactcagaggtcctctgttggtttgtgtctaggctgggaggggccctctgtgcttggcaaggccttgggctccgaaaccctttacctgcagctggtgtgggggctcagactccaggtggacagcaggagtgagtggggaagctcaggggccctggatgtctgcctgcattcactcatcctgccctgggtaccagaggagggaccctcttccctctgtgtgtttgtctcccccttcctaattgtgaaaacccttagcgacccaccccagcctcacggtgctggcctctggcccagagggagagacctggttggaaggacagatggtgtaggcaggccagccggccggcctgtgggtggagcagatggagggcaggccggatgccccgagggtctcagctacactgctgtcccacagccccaccaccacctgaatccctgagtcctacccacactccctgatggggcaggaaaggggagccccagactgggatgcctgagtgtatgctacctgtggtgctggtggacgggcgccgtggcctggctgttcaggacggaaagagccgcctgggctgctgatggagagtgacagtgccactggcttttgtgaactcagaggtctgtttctttcttcacatttattgaaattagagactcgtttgcaaattttaaaagatgttatctttgtaatgaatcaactacatattcttgaaaactgagtgtttactcatctgtatgtgaatctgaaaagtgtttaattgcgtactttaaatcattccctgcatagtagaatattatttttgcttttaaaatgcctttccctggtaagtattacaccgtgtatatgtgcatccaatcatcactggtacatttcgaatatgtacaatctttacttttcaattgaatattctgaaaatacctttcacatatataaaacaataaaaaagtaaatatttgcttttcttaggatgcacacctttatttttggaagaaaatttcccaaagcagatcatcttattttagttccagaagagaattttaaatatgtgctgacattggttggtaaaaatactaatatttaacccagttgaatcaaaaggcaaatgtctttttaatcacttcctaatgatctgtcttggccaacttaggttattaagagaaattactaagtgtccttatgtagcacaaaattcattgtttaatatattttaaagaaatgcataaaaagcagtagatgttttaaaaatgcatgggttgtaaagggccccaaaatgaaacttcagatcgcaaaggcaatgtattcgaaagtctcaccgatgattcatgagtcattttggtgctaactggtgggaatgaagggagatgcctgtggggaggtccagggtcctgcagctctgcggatgggcggccgtccggggaggcccaaggtgtggcgagatcggggagttcttctttcctgatgttgttgtgacccgaaagtctgtgttttcttcacctgagagtatcatgtattttcaaatggggggctatccgctcagctcccccagccgtggggtggggtgtgggtggcaagccacccaggtgccgaggcaagagaccgaggacacgagctgttccagtataataaaatataaaacaagaatggttattccagatatagatcttagatatgattatatatgaatatcattaatcattagtttgtagcaattactctttattccaatattacaataatcctcactctacaatcataacccaggaaaaaccaggccatacagagataggagctgaggggacatagtgaggagtgaccagaagacgagtgcgagccttctgttatgcccggacagggccaccagagggctccttggtctagcggtaacgccagcgtctgggaagatgtccgttgccaggtggactgtggtctagcggtagcctcagtgtcacggaaaaacagcggctacttagcagaccgggaaagggagtttagagaagactctgttcctccacctcttgtggagggcctgacatgagtcaggctcgcctgcagttatctggaggcctaaccgtctccctgtgatgctgtgcttcagtggtcacgctcctagtccaccttcatgttccatcctgtacacctggctctgccttctagatagcagtagtaaattagtgaaagtactaaaagtctctgatatgcagaaataatggcgtaagctgtctttctctttgcctcctctctctctctgcctcggctgccaggcagggaagggccccctgtccagtggacgcgtgacccacatggccttacctgtgattggagatggcttactctccttatctttcccttttgtcttgtatccaataaatatcagtgcagcctggcattcggggccactaccggtctctgcgacttggtggtagtggtcccccgggcccagctgccttttcttttatctctttgtcttgtgtctttacttctacactctctcgtctccgcacacggggagaaacccaccgaccctgtggggccggtccctacagtggggcactgcgagccccttgctgcctctgtgtggccgcccacccttccagtgttgccctgacgcccctcccgggctgtgctgaccacccaggcctcccaacttgtttcccagggtgctcgctaccacctggtttacggtttctttgtttagttctctctgcccgctgatgccagtttttgaactttatcattactacttctgtttatgtgtaaatgttccaggacttttatccaccgccctgtccctaggaccttttgcataccgctgttggaagacagaggcttcacatctcctgcagaggggtctcccgcttgcttcaccagtgttctgagggcacctgcatgtttagagccgcagcctctgtggaaggcacactccttcctaggaacaaatgtggttctccttcctaaggaaaagtggattatcagatttccaaactagttttgcagccttatagagaaatgttgcgataaaaattctagttttaaaattctgttccataattgtcatagaatcacagacttttccaggccgtggtccccaccagcacgttccatagcagacatcgccgaggggctggagcagtggatgatctgcctgggtcacctgggtggcgtcagcgcggccctgcggccctccccttacgggtttacattgggaatcaagcttcatggaggtgttgctcttgagccctggatttgagacagtacacgtggggaaagctaagcatctctaattgcaagcaccgtcttgcatttagaatggtcgcttgtagccttaacttagaaaaggagtctcgcccttgacctggtgtccttgtgttgcaggcgtggtgtccctcgtggccgttcacccctccaccgtcaacccgctcgggaagcagctcttgccaaaaacctttggacagtccaatgtcaacattgcccagcaagtggtaagcctcccgcaggagcggacagccgggatctcggtgtgaggtcgggatcggatgagccgtgtggttggggatgttcccaggtgtgcctggatttgggctccagttgcagcatggggcctttccctcatcagggagcccgtggccagtgctagattttccatagccctctgcagctgcccacgtgttgttgtgggagaggtgatggcgcccacagcactcctgtgtgccccagcccatgccatccttccagtaactggagggtggtgggtggggccgcggccccaaccagaggcagcttccttttagtgtcagagctcgaagctcttcatctaacaggggcttcttacgtgatgtggccgagcgttggctgtggccctcctggagacatcaggctgggaagccagagagggatagggccctggccgtggctgtgcgtttgccccggggcagtgacagggcagatgctgctcccttggccacgcacaggagaggggaaggtgggcattgggaagtggcgcatcccccctccccaggctgatgctggccaactgatgctgcttctcataatgctgtttcctgtctcgtgtccgccctctgcgtccttgccggtggcagcctactggagacagggagcccacacagaatcctgacctcaccagaaatggggccccaggcacttggtgggcaggtttggctgtgactggagctggtggtgagggacatagccatcccaaggctaggccgggcttccagtccttcctcagggacttgtttatggtgcctgagggctccttcctggtcctgagatgatgctgtggccccgcctgggcagctgccccagccctgttcctgccaaccctgggctttggtgatgcagcacctcttgcaccccggcctcctggcccactccaccccctcaccctgctccgtctgtgctgtggcccagtcctcttaaaaggattgaacacctccgggtgggatgagaacctgtccgttcactgtcaccaggtgtctctcaggcatacccaggtgtcctcacgtgtctctcgggtgtcctcaggtgtctcccaggcatcctcacgtgtccccaggtgtccccaagtatctctcaggcatccccaggtgtcctcacgtgtctctcaggtgtcctcaggtatctctcacatgtccccacgtgtctctcagggtgtctctcaggtgtcctcaggtgtctctcagggtgtctctcacgtgtcctcaggtgtctctcagggtatctctcacgtgtcctcaggtgtctctcagggtatctctcacatgtcctcaggtgtgtctcagggtatctctcacatgtcttcaggtgtctctcagggtgtctctcacatgtcctcaggtgtctctcagggtatctctcacatgtcctcaggtgtctctcagggtatctctcacatgtcctcacgtgtctctcaggtgtctctcaggatatctctcacatgtcctcaggtgtctctcagggtatctctcacatgtcctcaggtgtttctcaggtgtctctcacgtgtcctcaggtgtttctcaggtgtctctcacgtgtcctcaggtgtttctcaggtgtctctcacgtgtcctccggtgtctctcacttgtcctcaggtgtttctcaggtgtctctcacatgtccccaggtgtctctcagggtatctctcacatgtcctcaggtgtctctcacgtgtcctcaggtgtctctcacgtgtcctcaggtgtttctcaggtgtctctcacgtgtcctcaggtgtctctcacgtgtcctcaggtgtctctcacgtgtcctcaggtgtctctcacgtgtcctcaggtgtctctcaggtgtctctcacgtgtcctcaggtgtctctcaggtgtctctcacgtgtcctcaggtgtctctcacttgtcctcagctgtttctcaggtgtctctcacatgtccccaggtgtctctcagggtatctctcacatgtcctcaggtgtctctcacgtgtcctcaggtgtctctcacgtgtcctcacgtgtttctcaggcgtctctcacgtgtcctcaggcgtctctcacgtgtcctcaggcgtctctcacgtgtcctcaggcgtctcacgtgtcctcaggtgtctctcacgtgtcctcaggtgtctctcacatgtcctcaggtgtctctcacgtgtcctcaggtgtttctcaggtgtctctcacgtgttctcaggtgtctctcacgtgtcctcaggtgtttctcaggtgtctctcacgtgtcctcaggtgtctctcacgtgtcctcaggtgtttctcaggtgtctctcacgtgtcttcaggcgtctctcacgtgtcctcaggcgtctctcacgtgtcctcaggcgtctctcacgtgtcctcaggcgtctctcacgtgtcctcaggtgtctctcaggcgtctctcacatgtcttcaggcgtctctcacgtgtcctcaggcgtctctcacgtgtcctcaggcgtctctcacgtgtcctcaggcgtctctcacgtgtcctcaggtgtctcacgcgtcctcaggtgtctcacgcgtcctcaggtgtctctcacgcgtcctcaggtgtctctcacgcgtcctcaggtgtctctcacatgtcctcaggtgtctctcacgtgtcctcaggtgtttctcaggcgtctctcacgtgtcctcaggcgtctctcacgtgtcctcaggtgtctctcacgtgtcctcaggtgtctctcacgtgtcctcaggtgtctctcacgcgtcctcaggtgtctctcacatgtcctcaggtgtctctcacgtgtcctcaggtgtttctcaggtgtctctcacgtgtcctcaggtgtctctcacgtgtcctcaggtgtctctcaggtgtccccaggtgtctctcatggatccccaggcatcctcaggtgtccctggccctgtggagagctctctgtactgagctgttttttgttgtctagggcatctccctttggtctaatcatgttttcttcagagaacatgaccacataccagggatattttggtcatttttgcactttagtctttattttatatgcattcctgctatttccgtttatttaaatatgcttgaaattctctggattctttaacagatgttaggatatgagttttaagagagagtggcttgtgggtcacagccttgaggatctgagcaggattgccttccccgcgctcccttccccgcgtcccacttccctgcgccccgcttccccgcagcccccctccccgtgtgtgctcccacacagctgtcctgattgagcggttccagatcccaggcagcttttgtggccccgtttcctgcctgtggaaggtgacaaaaaacttgctctgcagaagttttgtggccattgaaagtagcggtttgtggaagccctaccacgtcatacggcttttcaaccacgttgcacagcagatcacggcttttcagtaaatgccattttgataaaagctaaaaattcagtttttgttttgcttgataattagattataggtttgcttataagttgactaggaattctaagtttgattttataggtgctgtgtgtcatagcagagtttgtctgggtgaataattgtagcaccactttcgtctttactgccggtgtgaatacactggggggaaacgaatgagaagattatcttattgatgtgctttaaacttcgtcactgaaagtcaagttcctgatttaaattcagctgttcgggtggagtttgtcattgctgttttgtgctttgcaaaatcccagtgatgggaattaaagctgacaaagggcaaatgtttcttaaacctttttatataccagaggtttacaaaaaactggactggctcattctgacacgaggggtggggctcagtccgggcatgtgagtgaaagcggtggggaggtccttaggtctctgacctgcaccagtcagcaggcgcagggcttgtcaaggtcagggtcttttgaggtgcggatgcttgtgaagcctgtggtgctgcagagctcagcacgcgcacaggaacgtgtgcgggacagaggacatatgtgctcagccggcaggagcagcggcctgtgtgagcccctggggagaagcagccccccacccaggcctgtgtcccagaagtcggcatctgtggtcgcagtggcctttcctttgcagctgcgccactggccctgtctctctggacaccgcggttaaccttggtccatctctaggattctgtgtctgagtggggtcacactacacggagacatcgtaatctcagtttttagagtgtgtgaaattaaggtgcaaaaagtgtgcacttagggcagaagggatgccttaaatcaggagtccccaacccctgggcctgttaggaagctggccgcacagccgcctgagccctgcctcctgtcagatcccagcattaggttctcaggagcgcaaaccccactgtgaacggcacatgcaggatctaggtggcactccgtatgagaatcgaatgcctgatgatctgaggtgggacagtttcttcccgaaactacccccgactccggtctgtggaaaaactgtcttccacaaaactggtccctgataccaaaaaggtgggggatcgctgctttaaacaccaaggctcactgtgcagccagtgaggaggggagctcctgggggaggagggttggtctcgggcaaggtggacctccggcaggtcctctactgtgggatgcttccacctggagctgttttctaacgactgctggcgtggaagctgcaaaagctttagagtcgaaagactgtgtctgaagccgtgtaaagactgtctggagccgtgtaaagactgtgtctgaagctgtgtaaagactatgtctggagccgtgtaaagactgtgtctgaagccgtgtaaagactgtgtctgaagccgtgtaaagactgtctggagccgtgtaaagactgtctggagccgtgtagagactgtgtctgaagccgtgtaaagactgtgtctggagccgtgtaaagactgtgtctggagccatgtagactgtgtctgaagccatgtcatttactttctctgaagcgcagcttggattccagccgtgagcacagtaggaagggagaccccttatgacctgtggggcctgggtcacctcccctgctccccagcgagaggcgggtgagggagtcgtgagggcggagcccatcctccagagaagccgctgttaaatctaaggggtgggtgtccctggcgcctttcagcccctgcctgcctcctgctcccagaggctcctggatctcctggaaagccctggttggagtgggacccacagcctcccagctttgggcagtacccctcattgtgctgtgaccacttctcccttccagggtctctgcccaccactccagctagcgtggccactgcttccaatacctcctttttttccctaggggcccagctctgaactatccttcccggcactgtcccatccaccctttggcacctccttggttcctgttttccctgcgcttctgcccacacacgccctccagggcttcagtgtgttgccgtgcctcctctggctgttgagtgtggctcctggtgtagggaagtgaggccgggggcctgctccatgtctgttgaatgggagactggaaggcgtcctgtggcacaggcggccggcccgagttcaccggcttcctgtgcaccaggaaggaaacgcacacacctgtgccaggtccgggagcaaagcctctgtctcgttcctgggagggctggctccaggccgcccctgtgatgctgactcagctcacagggctggtgagcagcaggtgatgggtgaggagcagggacagtgctgcggagacacagtgaggggagctgccacgcagggcacgcagaggaaggtgcaggcacccttgcccagcactgcatgggccggatgccgcggggccttccgcagggagcagttaaagcaggagagtaaggagagcttcctgtaagacctggcctccgtaaacaacgcattcccagtgcactggtggctcgttctcagggtgcccctgggtgctgagtcctgtcttccaggaaaggttgttggtgagcaccattgagcacctggtgtgtacctgcctctggctttctcttcttcccaacttacagtgggtttgacctgtgattttgactttaagatggtccaaaagcaacatgcattcagtggaaactgcttccactgcccatacgaccgtcctatttttcattttgagtgtggtattcagtgggtctcctgggatacccacacttgactagagtgggctttgtgtgagatgcttctgcccgactgggctaacatgcgtgatctgagcacgtgtaaggtaggctggctaagctgtgatgtgtggtaggagaggtggatgacgtgcatttcgacttagggtattttcagctcatgcgggtttatcgggatgttccttgtaagttcctcgttgtaagtcagttcctcgttgtaagtccactctttgtgagtaggtttgctcctgcctggaggacagcggcacggtgacggcatctgttttggggccaagatccagtgccttgcgtggtcctgggattcctggggaagggagtggacccatgaggtgggttagaatcgtgtgtgggattctccagccccctgtacctgtgcgtgtggtatgcgcggagccagccagcactgcctggcgtggagctggcgggttctcagtctgacatcaactcccggagaatggcatctgctgaactcaacgtaggaagccgtgcggggccagcgcgctctcaggcagcctgagtggcagggtccttttgtcagctgtttggatctcccacgtggcccagtgccccagcagcacacacacacacacacacacacacacgcgtattgaacaaaacaagtttcacaggacatttatccacgcccaggagatttatcttttgtatggcttcattttgcagaaaattcacttgtttgatttcatggcctggtgatccacagaaggccgcactctgatgagtctctgatcatcggagagatgagtgtcaatgaaaagatcagtccttgaaatgtttttcttctccggagctgacaggtgatctggcctagggataattggaaagtgtccccgtcagctgctcccagggccaccgcaggtgatgcatttatccccgtaagaaggggagctgggggggcccagcttagagtagctcagggcatcggccacatgaagcccccccgccagcatacaggtgtccagctccaatccctttaacggaaactgcatgtccatacaagcagtataatcgctgaggcactttgatttgtggtgaattgaatgatttaacatttactgagaaatagtgtttccagtttagatagagtcgtgccacaagatctttgaaaagtcagagttgtatttgcctgtatgagggtgtccaggtattcacactcgaacattcattgttggaactaaagtggtaagaccttgtcaagagtcagaccagccagcatgtccctgaagggagagacagttgttgacaccctcaggtgtgctgtggggtggggcgggtgggtcagtgtccacactggcgttgcctctggtggttccccccagaggggcccaggtgtgtgagccccaggggcgtgtggagcccctaccttccgcccccagtgctggtggccctccctccttgcctgacgccgttgtgggtgcaggggttcccccagacagggccccagggcacagggttaccaggtgatggctgtcaccctgctgggctggaggagcagctgctgtcaccctgcctgtgcttttgtcttttgagagctgtttttggtttgtttcaggcctctttttagtaccacagaaggatacaatttcatcctcatccatatcactaaaaggaagtaaaagggtgaagggaaaaatggaagcgtgctcaagtgccctgtgtggaattctgtgccgcccccttcattaaacttgaccgttagcgccttgtgtgcggtttgggggtcacgctctgccctgtcctgttcttgcttgcttgggtcgtccgaagtttcttgttgcttttgtctaattggagaagatgcctgtgactgacaagaggaagatgagccacattcagaaccggtggggtgatgccgtcaccgtgacaaaagcgtccaccgctggacgtttttcctgctccgtcatggctgctcactgtggttaaggaaattcagcagtggctgcggatagcgaacagatggtgggcatggcaccctcgccgtgtgggaggggactgactgtctgaattgtctttttcgactgtaggtaattggtacgcctcagagaccggcagcgtcaaacaccctggtggtaggaagcccacacacccccagcactcactttgcctctcagaaccagccttccgactcctcaccttggtctgccgggtgagcacttccctctggacccttagagttgtaggactgcttgcggttcgcacctccacgttctcctgggccacgtgtgtcacacagtcgtgcgatggggctcccacgcgcgttgacgccagcctccgaatcacactcacccatcatcgtggcctgcacaggtgtgcagccgaggcgcactgcctcggtcatggagaagtcgggctgggcaccgcccaccccgctttgtgtctggtgtagtgggtgctctctgaagggctggcagctcttggccaagacggggagaagctggcctcgtactcgccacaggacctcggagactttccctcgtctgtgctgggagcatgtgggatggatttcacccactgcccctgaattcagcctctactgcccctggggttacggcccccgcgggtggtcccgccagagctgctccttccactaaagcaagatctgatgagctgtgtctttccttaaaaacacacacacgcaaagctgcaaaagcctgcctgtgttggtgcccaaagcttcaccagctaggaacctcaggtggcctttcccgccatgtggggactgaccagagtgtacagagttgggctttccctcgacctgaagcacacttagtgctttgcacctgttgtcaagcggctgtcacagcccaagctgtatgaaattacagcctgctgaaattagtcctaagaattcccaaatttacactgaaacgtcccatagttcctgattctggctgccctctttagaaaagtggtgcttggggctcacgcctgtaatcctagaggccgaggccagcagatcacgagttcaagagattgagaccatcctggccaacgtggtgcaaccccgtctctattaaaaatacaaaaaaattagccagatgtggtggcacgtgcctgtaatcccagctactcgggaggctgaggcaggagaatcgcttgaacccaggaggtggaggttgcagtgagccgagatggcgccaccgcactccagcccacgacagagcgagactccgtctcaaaaaagaaaaaacaacaacaaaaagaaaagtggtgcttggtgtaccggcacatctcccatatgctgatttgggtcctggggacgcctcccgttttccctgacgcttggaaggttagaggtgcagcctgctggggagacactcgctttctgacctgcaggaccactgggcctgggggctggggctagggggtcctggcctgctcacgtgttggatctgctgcgcccgtgggacgtggcccctttttgtgcagctcattagagctctcaggtaaaagcattcctcgattcaggctgatcctcaggagggctgacagtcgcttctcttttcctttgtattttgaaggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagtaagtgtgtgccgggggccgagaggctggggtggcggagcccagcggtgtggtacgtttcgctcttttaatatcgggaacagttaaaaccatacagaaaatgccaagtacagcataaaagaatttttaccaaacgagtcagtaagtgtgtgccggggccgagaggctggggtggcggagcccagcggtgtggtacgtttcgctcttttaatatcgggaacagttaaaaccatacagaaaatgccaagtacagcataaaagaatttttccgatccatttgctggcacgatgctttgtcaactccagtgagtgagcacgtgggctggctctgcacgtctagcggcccagaaatgcacaaatgcccacctcaccagctgggctcgacacccgagagcccccggctctccttctggaacacactcaggcttcgcacagccccgtcttgccctgcgtcatctgtggggtgggagcgctccctgagggcatgttggggtggcggctccgtgagcggggtgcccctttgagccagtgcccatggtctacagtttaaggatccaccggcctttttggatcatttggaaactccactccctgtcatccccaggcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtgccccttcagccttccttcaaccttgatttcccttcaagtccgtgtagatgttttagtcgtcggtcactcagaagggtctgggctccgtgcccttatgctctctgtgtccggctggcagacggtcatgcagacgtctccctgcgtttctcagtcttggctgtcaggggagggagcatggttggcccagacccactagagtctgttaaactctagtgtaggttaattctgaatcctagtttgtgggatttttgttttctttttagataccatagttaaatccaagaaatgagaggaaaggggagaaggtatagtttagaaatggaaaaaaaactcacctatatcttgtagcacctgctatgtctagatttgtccatatcccttcgattacattctgggtaaacataggtaacactgtgaggatgtgaggatgtgggttttaaaaaacgctctgtggaacagttgtgatgattcttcacatgggtggtttgtttttgaaggtggaaagacagaggagacttgaaagaataaaacagaaacagtctcaacttcaagaacttattctacaggtaagagaatacgtatctgtggaggcagggtaatttttattttactaatttagctttataacggcaacatactgccttgggttacactcctgcatggcaaatcaaatgactgctctaagattctgagtgtgagttcatctcataggtgttgaacgtgggccttattcccagagcgaggttgtgcacgtgcgtgtgcatgcatgtgtgtgtgcgtgcatgcatgcatgtgtgtgtgtgtgcatgtgcctgtgtgcgtgcgtgcgtgtgcctgtgtgcgtgtgcatgtgtgtgcgtgcatgtgcctgtgtgcgtgtgtgtgtgtgcatgtgtgcatacatgtgtatgtgtgtatctctcgtcacagcatctaaataggcaaaagacagatggagggatgacttcatgcaaaagcaacatttgaaaaatctcctcagaggtgcttaacccaaggcccaggtgccaggcaaggcctgtaaaactgtggtggacacagtgcacctgggtcttgacagtgctgatcagggccctggagctggccttccccacctcccattgagtgctgagggtgggcggcaccactgggggccccgtgtctggtgtggagggggttgtgtgcaaggtgctcactgcagagctggctgctgccctgaccaaggtgtgctcgagccctcccagaggggacggtgtggcagccgtggtgatggaggctcgtgggcaggagctcctcaggacccacagagtgtcaggagggacagtcctggttgccagtgccttaggacctgccaggtggggatagacccagggtggccgggagaggaagggaatctcctggctctacattaatagcaaagaaggtctctccaagtggaacacttggtttggggccctgaggccctggccctggattcagccttgcagggcctattcccccagaggagcacccctgcagcacatgggcccttctgcgttccactttccagggtgggcaaagtccacggcacggcaccccctccaaggccatcaccctgtaggtgccatggtggtaggtggtcttagaggggtgaaggacagcaaggaatcgacttccaaaattggtgttttgttgagcgccgttgccgtggaggacacttttatcagggcacggatggctgtgcgcccgctttcccttagttctcccctcaggatcccgtttcctgagcgcttttctccctgggctgcagaggtcagcacccagcggccggcgctggcatttcagatgtccaggccaactcctcgctgtcacgtggacgcagggagggctgtgaggacccctcgagcacaggggctgcgttcttgtgccgccacgggccacctggctcctcttattttttttagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaagtaggttgtgggcggggagctgttccctggtcacccatctcttttttagggagccgaccctgttggtattgtcactaggacaagttttaaatgttgtacaaatagcaaatgttgcacaaattgctgtccattggggggtggtgggaggctgccgccatgtggcagatggaaggtctctgttccgggagcgtgtgccttagggcatgtcctcctggggagaataggcctcgatttgcctctcatctcatttacttcagagtttataaattctgtgaggagacactgatgactgggaaccgggaagctgtgtgtggcggtcagcgggtcagccgtcctggctccaccccagtgtgtaccgtctccgctgggagaccctgtctttctgactgtgcctttccccttcagatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacaggtcagcaatgcccagacaacctggcgtggctgtgtgaggaatggcccccagcctccgacggtgccctcccctcccggctcgggatgtgtcttgctgagatcaggcccacgtgtgtagggccaggagcaaagacaaaggggctgtgagggggatgagggcaggggtgtggctggggtggggtccagccagtgccgtgacccactggatatgggggccttgagtccacaggtggctcgtgtggatttcctatgtggtttgtgtgaggaggtgctaagtcaggattttaccctccaagtaggcccagaagtagaagttgagattctttgagaagtgcagttggattgctgatcccacccactgatggtagctgattggtcactagggcaaagtcaccaagaaaaagcatttcagagtcattggcgtcctgctccggagggccgggagcacaggagcttttgttgaaggagctttttttctgttctggtgaattctttccttgggggccgtagggtcccagccactgacagcaggatggctttaaggtgagaaattgtgaaggtgtcatatctgctgatccttctcttgttagcctaaacttggggtgtagatttattccctgagagggtcagagattcctccctgagctcttagactgccccagatcttgtgaaaatctggctggtccatgttgtcaggtgacagtgggctctggccgcccacgtgggctgggccctgaccccggcctctgtcccgtgcttcatggagctgccaggatgggctgtgggaagagggtttcagcttgacactttgattcggttccgtttcacgatgggtatgatactgaggcagcagcacacgtgtgccgtttgtaagtcagtgtgtgcaggtatttattgcaaggctgttcttgcctttttagagaagacaggcttatgtgactgcacagcgggatgtcctgctccgtggcgcagtgtggaaaatactggacaagcgaaggatatccggaagcttctacagccgtctgtcctgtggaactgcgcgtcattttgttggttgcctgtgcgtcttgtgttgtttctgtttcatgaccattcgcttattttctttcccttttcagaaatggctcagggaactgttggaggcgtgttcatcacgacggcaggttccacgtctaacggcacaaggttctctgccaggtgacagtcgttgagggtgtgggagaggcgtcatctgggcctcccccggggtccaggggccaaggcagggcagccgtctcaggtgtggccatcaggtctgtggctgctctgacgtggcttgtctgtccaggcagtggggccccgctggctttccctgtgtggagagctgcttttcttagttggtttctgctcactaaaaactgaaagtaatacatggtggtttttttttcatagtatcacctaataagtaaagtaggaatgaaaaccacccaaatcctcctgtccccggcagcccaagtaacagcaagtatttccaggttttttttcccatttttcagaacgcgtctgcggtcacagcgcacgtatttttcagaacgcgtctgcggtctgggcgcaagtagttttcagaacgtgtctgcgatcacagcacacatttttcagaacgcatctgcggtcatggtgcatgtgtttttcagaatgcatctatggtcatagcgcatgtatttttcagaacgtctgccatcacggcgcacgtgtttttcagaacgcgtctgcggtctcggcgcacgtgctgcgatcacagtgcatgtatttttgcgaacgcgtctgtgattatggtacacgtatttttcagaacgcgtctgcaatcacagcgcacgtatttttcagaacgcgtctgtggtcacagcacacatattttgttccgtgcatttttcagcttacattttattgtatgaatatatattgtttctatgctattaaagggcctttatttaaataaatttgtatttaatctttgacctgcaatcccacagagtagaatggtgtccctaggtattgatcttagtgcttcaaagataaatataacttttatggtaaatattaacaaaacaatgattttattaacttttatattgcattgtgatacaatatatagtattactttatattaatcttaagtgttaataaaatctttaattagaaatacaagaactcagtaacctatgggtccgggtaacagggctcgacatagtgagtttcagtgtgcttgagcctgcgttgggatgtgctgtggccatgagatgtaacaggtgtgtcgggcacgtgtagcttcctggccagctctggaagtgcaaagccagccttggcctcctcacctgtaaggtgagactggtgattgatgagttactgatctgtggcaaggatcagtgaggtggtgatggaagaaaggactttggtgacaagcttttgacagaggccggttctccttctgttgtagctatgtgtgaacgtgtggcggtcagtctgtaaacatgtttaatgctgcttcttccatgaggtgggatgtgggtatttttaggacttttatcatcacataatcctttttatggatgtgattcttcagacttgtcagtttttcataacaatggaaacaaagctattaccatttcttacgaaataccgattttcatagtggcatgatgagacattttatacaagtacctcatgaaaggacatctaggtagttcccagttagaataaaaactgcagtgagcagctttacagctgaatttctcgccatttctgacttgtttccaagatacagaattacttcatcaaaaggcacattaacacatttttattgtagtgttaataaataccattaaaatgtattaaaatatgtacatatggttttatgttaattgaaaacatctttaaacattaggaacgtagtgagctctggttggtggtaggtttttgtggtgctgccagccctctgggttctcagtccccgctgccagattcgacccacgctctggactccatcctgtcctgccccgggctctcttttttcctgttgctggttatgagtgaaagtcccggagggagggatctaatggttttacagtttgttccctctggggcactgctcctgatggaatgatgagtgagggagaggcagcgtgtggctctgctcagcctcctgtttctgtcgttatgggttccaggagacagggccagaagagaaccagacagagatggagtaagtgccagagcgttggcgtgctgtagtgcagacactcagcctccccgttctgtttgtgtgactgacaaaacccacacctgtggggcacagcctgtcatttgaccacaagccctgaggcggggggaggctgggtgggccgcctgcactgacggcgccatccgcctcctgccttgcagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaacaagctgtgtttctctaattcaggattattatctagaaatttgtctgtcttgttggttttactttatacttgagtgagaaagtaggttgttaggcccagacgcggtgggcccgggtggtccctgtgggtgcaaaccccaccaccacatgttgtctgaggcacatcctccgggagcccaccctgaaaaggtggaaggtggccaagggtggaggtcttggtggacacagggcaaagaggcaccttccttttcggtgcctgtggtgcagagaaagataagccaagttccttggccttttttcacaatgaaaattgagacaaaatttaaaagtttgactttgagaacaagaataagattgagaggattctgggaagatggtggaatagggagcaccaggaatctggctgcccaggtagatgtctacctcgcgggcaggatctgcctgatgcagctgttctgtaactacggaatctactgaaggcttaaagctttcaagggaggcttggtcagcacattgcagttaattttggtccatttcagctttctaccccgacctctgttccttcatttttctctttccccttttgggagccagacattgaagactaggacgtataaaaacaactgtgttgtatatatggggctgcccagggagaggctcagaaaagacccgagaagaccttacgtttacacctcaggctgaaccatggcacaggtacagcctagagctgtcaaaaaagcaataaacacagcaataacaaaaatggcaaatccgggggaacaggagacttcttttcagagttgtaccacagtaatagattcagatgtccagttttcaacaaacagtgacaaggcataccaagaaatggcaaagtatggcccatttaaagggaaaaaaataaaaacaaactgtccttgaaaaggatctgttggcaggtacactagacaaatacttttaaataactgtgttaaagatgctcacggaagccaaagaacatgtgcagaaagtcaagagaatgaaaatagaaccaaatgcaaggatcataatgaggcagacaacctgaaaaaccaacaagaaattctgtagctgaaaagtacagcaactgaaatgaaaaattcatcagagtgattcaaaggcagaagtagcaaatttgaagacaggacagtggaaataactgagtctgaggagcaaaaagagaaaagattgaagtgaacagagcctgtgggccctgcaggacaccatcaggctgaccagtgcacatgttgtggggtctatgaaggagaagagaaagaaaggggcagagagaatatttgaagataataatggctgaaaacgcaccaagtttaataaaagacatgaatataaacatccaagatgcaccatgaactccaaggaagataaactcagagatccacaccgagacacattataattaagctttcaaaagacagagaagaccttgaaagcagcagagtaggagcaattcatcacatacaaggggcccccaataaaattatccacagagttttcctcagaaactggaggccacaaagtagtgggccagtatattcaaactgctaaaagaaaaacaataaactaccaagaattctacaactgacaaaactgtccttcaaaagtgagggcgaaattaagacattcccagataaacaaaagctgaggaagtgtgctgccactagacctgccctgcaagatgtgatcttatatgcaggaaatctgaaagaatccacttagtttcagacactagaaaaaaatctaaacccatagcaagtagagggaaaacaatttaataaaaattagagcagagctaaaatcagagaacaaaaacaaaggagaaaatcaagaaaccgaaaagtgtgtttagatcaataaaaccgacaaacctttagttaggtatactaagaaagattgacattactaaaatcagaaatgaaaatggggacatttctactggctctacagaaataaaaaggattatgagagaataataggaacaattgtgtgtcaacatatttaaaaacctagatgaaatggacaaattcctagagacaaaacctacccagatttaataaaaataagtaaaaatctgaatagacctttgactagtaaggagattgaatcagtcctttaaaatctcactttggacctagtggcttccctggtgaattctgcgaaacatttgaagaataactaccagtcctcaagcttttctaaaaaatggaagaggtgggaatacattctgattctgtgaagccaccattactaccctgatatcaaagccaaagacaccacaagcacaaaataccaacatgcctgaggagcactgatgcagaaatcctcaacaaaatactggcagcgtatttcaaagatcatgcaacgtaaatgctagcagcgtatttagaagattgcacaccatgacctagggatttatttttagaatgcaaagatattttgacataacaaaattgatcattgtaatgcacacataaacggaatgaaagaaaaaatcatgatcatctcaatgttttattaacagcttttttttttttttaaattagggatggagtcttgctctgtcacccagggtggagtgcagtggcgtgatcatagctcactgcagtctaaaactcctgggctcaaactcccaccttatgctcccaagtaactagaactacaggtgtgtgccacaatgccaggctaattttttgattttgcacagatagggtctctgtgttgcccaggctggttttgaactcctggctcaagtgatcgtcccaccttggccccccaaagtgcttgaattacaggtgtgagccactgcgttcagctgtagtcattgcaagtgatgtacaaaaagtattttataaaattcaacatcttgttatggcaaaaagaacaaactaggaatagaaggaaactacttcagtatagttaatgccgtatatgaaaaactcaaagagaacaaacatcaaggtgaaagactgaaagtttttcctctaagataaggaacaaggcagagatggccaccctggccttttctattcaacatagtactggaagttctagtgaagcagttatgtgagaaaaataaatacaaggcattcgtatttgaaaggaagaagtaaagctatctccatttgttgatgtgatcttatatgcaggaaatctgaaagaatccactaaaaaacagaactaataaggttacaggttgtaaagtaaacaggaaaatcacttgtgtttctgtacactaacaatgaaaatatgaaaagggaattaagaaaataattccatttacaatagcatcaaaataatgaaatacttaggaattaacttggaggaggtgaaagacttaatacagtgaaaatgacaagacattgctaagaggaattaacaaatggaaacgcaccccatggctatatattggaacacagtattgttaagatgtcaacactacccaacttaatctgtaggttacatgcaatccctgtcaaagtcccagtgatttgtttttcagaaataaaaagtctcatcctaaaattcatacagaatctcaagtgacctcaaatagccccaacaatcttgaagagcaaagctggaggactcatacttttggtttcaaaactacaaatctgtaataatcaaaacagagcagtattggcataatgaaagacctacagactaaaggaatagaatagaaagcccagccaaacaccctcgcatatttggtcaagtgatttttttgacaagggagccaggaccatgcaatggggaaaggatggtctttttcacaaatggtattgggaaaactgattatccatgtgcaaacaaatgaggtgggacccttaacactgtttcagtgcaaagcttaattcaaaatgaacctaagatctgaatgtaaggcttaagactgtcaagctcttagaagaaaacagagtggccgattgtggtggctcactcccgtaatcccagcactttgcaggactgaggcgggtggatcacttgaggtcaggagtttgagaccagtgtgcttgaagccaaatgacgaaatcaagaactcagtaaaggtaaatatgtgcgcaactataaaagctagtattgtaagaggctagtattgtaaaagctaggtgaaaccccgtctctactaaaaatacacaaaactagcccagcgagatggcgtgaagtacacctgtaatcccagctactccggaggctgaggcaggagaatcatttgaacctgggaggcaggggttgcagtgagctgagatcgcaccactgcactccagcctgggtaacagagcgagactctgtctcaaaaaacaaaagaagaaaacagcagaagtttcatggcattggacttagcagtgatttttttggatatgacaccaaaggcacagggaaaaatagacaatgtggactttatgaaaatataaacctttcttgcatcagaagacaatgttgacagagtagaaagcccacagaatgggagaaaatgtgcacagcccctgtgtctggtaggggattaatatccaggatacatagagaactcttaaaactcaaaaaccaaacaacctgatttaaaaacaggcaagggcttgaataagcatttctccaaagaaaaatctatgaatgacttgtaagaacatgaaaaggggctcaacgtcactatcatgaaggcaacatagattaaactataaaatagaaaataaacattggcgaggatgtggagaaggcagagccctgtacacggtggggatgtaaagagccgcagccactatgaaaaaccaaatggctgtttttcacagaattaaaaacagaattaccctatgcccggcaattctgctcagcgtatacacccagagacatttgtacacccatgtctacacgtaccactattcagggtagctaaacagtggaggcacccgaagtgtccatccgtggatgagtggacaagcaaagtgtggtttgtacagacagcgaaatctttggaaggaaatcctgtcacactacaacacggatgccccttgaggacgttatactacgtgaaatatgcccgtcataaaatacttatatgaggtacttagagtcgtcgaatcatggagacaggaagttgaacggttgccaggagctgagggagaggggatggggagtgagtgttgaatgggacagaccttctctttggaaggatggaggggcctggaggtggatggcagtgacggctgcaggaccctgtgaatgtgcccagtgccaccaaactgcattaaaaatggttaagacagcagattttatattacatgtattttaccacaaaaaaaaaaaattggaaggacatagaaggtatgaaggagagctaagtgttttatttgagttggctaaatcaatcactgaaaattccaatagaagactagttttagaagaatcattttttcctaatcttgaattaccataagcatatcgagggttgtggaacttacataaaactacgggcagtcgtgcctcagagggctctgtgtgggtgcatgtgcagccagcacctgcgggtgcaccgtggcttcccgtggcgagcttcctgtgcctgtgtttcttccaggccttgggggttgaaactcagggctggtgattctgaagggtggggcaggagcagcccccggctttatcaggaaggggctctgatcgggcacgggggtgcccctgtgggtgggattgctggagcccaggacatcaaggccagcctgggcagcatagagagaccctgcctctgaagaaagagtggggctctggtgtccatggagagtctggggagggaggaagaggctagggttctgagggcctggagatgggggctctgggtggccatgggacacgtggcaggcgtgttgggttccagctgggttggctttgagagtctggtgggatgaaccctcatggctccaccgtcactttgaggtggtgtcacctctgacctctgaccttcagcatggcatgacctcgctgaggtgaccctggtgtcccacatatcaccctgagtgttcttaatacacagtcgagggctgtgttcattggactattctggtgtcaccgcccacttcatttctgtgcctggcagcacttttactcctggttgggagcatgaccgcctcccagttcagcttcctcctgcgtcccaagtgagcggggcggctgtcctcgaggactccgggctcacagccaacctgctggcacggctcgaggactccgggctcacagccaacctgctggcacggccgccctttcccgccctgcctcgggtgagccaaggacttgtcttctgcttcctgggttcctgaaagagctctcctctgatttctcaaaggcaaaataaaactcagatttaagtctttggtgcgtagcccctaatttccttccctttctctgaatcctcactgcccagcatgatggaccggcctgggctcaggacctgattccacaggctcccagccctcccacaggtaccgtgtcttctgtgctggtgtcgcacccgccggccaccgccaccctgcgtcttagacgtcccgccgcagctgtgtttccacctcatctccagcttgagtggcagccagcggcgccacctgcacacgagccccctccattcgagaagcacagactatgagtgtggccacgcgtcccatgacgtgaactcacgtctgcgccgagacctttgccggcggttttttactgacggagtaagcactggagatgcttggtacagcgtcttccatcggtaaattgatttagttaaccttacaacatatctgcaaggtttttaatctttcttccaagaccgtttctcatggacttttctgtgtgtctgttgggggctgacggacttcgacgcgccagtcgcttgtgcttggggccctttgggtactaacagccacactgctgagcatgtgaaatcaggacccaggctgcacaccgccgtcggggtgagacgcccgtggccttgcatgatgaaactgggacccaggcctcactgctgtctgggtgagaagtctgtggccttcagcaagagcaggtttgcttgtttgggagaatgttctcatttcagttttttgaaagggttagagctgctaacttaacatttatatttggaggagagacttgttcttggtgaacgagaagtgtgtttgtaactaactgggttttaaaccatcaggctgccgacacactcactccccactgtttgcctcccggagctgtgagcgtccttaggtgacaaccccacaccaacgtggtttttgtaattttcctgacttgcaatggagacttttagaaggagatttttaaggaagcgtttggtttttatttaatttctcccatatcaggaaacacgatttctttttttacatacaataagagtaactttaatatattttatgtttacaacttaggaattgcaattttaaaagcaagaattcagaatgtcattagtgtaagccgtgtttcatatcagtgcattagtagtttttatattaatgtggggggggcagttcatattgaagtgtagaaaaataaattatagtaagaaagtgatgtctacatagaagacgaatcgtttttatgacctggttaattagagagttgctgccttgcgttcccatggtagctggacattcttatagcagcaaattccatctaaaaactgtaagaattcaacaaggaagaactgatactcgcgagcaggtccttcagatgtgggcgcttctctggagttcgcacactgacaacaccgttgctccaaaccactttggggatgatttggcagggaactgacgggcaaggtaagcccaaccaggagggtgtccttgagcgaccccgcaggcgtgcccaggacccctgcgcaaaccgtttcacttctcaatcttgagtttgaactccactttcccttcatacgggtcgtggggattgttgaaggtcacgtgctccgccatgaccttgcacacgatggcgacctcagcgttcctggggatgttgaggagcttcgctgccaccagggggttgctgtagtggggctgaagtgggagtgaggaaaggacaggtgtttcaaaaatctctgaagttaaggagagaaaactaagcaaggaagtgtcaacagtcaggttggtgcagagaagcagctcttttgtgtaagactggccctgaccgagtgcatgccctggaatttgctgagataacaccccccatgtaaaaatggaaagcaactgtctggaggggacagacaataccaggagtaaattcagcttcaaactcttacgatgattaacgtaaaaatgaaacaggaaaagcacgtgatgtggaggaaagtcttcgaagtggatatgcagttgttttagaggatctgggaagtagaaaaattaggctgggcgcagtggctcatgcctgtaatcctagcactttgggagcctgaggcaggctgattgcttcagcccaggagttcaagaccaccctgggcaacatactgagaccctttctctataaaaaatacgaaaattagctgggcatgttggtgtgtgcctgtggtctcagctacttaggaggctgaggtgggaggatcacttgagcccaggtggttgaggctgcaatgagctaagatgctaagattgcattgctgcaatccaccctgggtgacagagcaagactgtctcaaaaaaaaaaaaaaaagttgaagagttagagttgtattttcatgttgcgtgagaggaatgtttccaggtagatacaagaacctgggcttgggaaacacgcagaacgttccagtcaggaccggctaagtcacacctttgtttcatttttctacatgaaggggcttattgctttcctttcgctaagtgtgagaggactcagcagctgtggtgagggaagcgtggaaggaaggaacctacctgggctttcttcccgtaataagggaagtagtgcagactgaaggtgccgttgggagggtagtacttgacctgcagcggctggccgagctcgcggggctggtcctggggaggagaggccactgcctgagtcaggcgggagctggtgtgtgccggtgtctgtgtgttgcgtttgtgtgcgtgtgtgcacacacgcgctgtgtaggtgcttgcataaacactttattgcatacttagcataaatcagatgcaatctttctaatcagtgctgagatctcagcaaggatatgatttgttagcatgcaaaatgcccagtgacccctccgtgtgcctctaacaacttgaaatgttggaaggatgacgcaggtgggtgaagctgggaggcggcttgcttgtctgtactcgagggtagccactgctcagtggcaagggctggtttgccaaaactgggttacaagttggtgtgagtggggcaagcgaatgcgtttttgtgagattggggccctctcgtttcagaagcagaggcttgcccagtgggtagctcagggtcatcaacgaacagctgaagggtgctttggatctgttagaatctcaggagccgcagtgtggcccaaataaattagaaaaggaaaagcaaatccccgcggcccccaccgagagtggaggcttcgagggaagtgaggttccctcggacaccctagtgggaaggctccacgcggtaatggaaccacgctgtgaaacctttgcctttgggtgtcatggtggaagcaaatcttagaagacatttaatttaaaaaattcagttttaaaaaatgttgacttaaaaagcagttttgaaaaacaacctggaattagcctgagatcgatgccaactcttagcagtctgtatactaaacacagttaaacaactgtagctgctggcaagctggaacctttttgtaaagaagcacataaaaaggacagaactggtggaaggtgcactggtctttccacatcgccaccaggcgttttgaagcgtgctgctgacacgctactcagatgcttctggaagccaaacaataagaaaaagccccattgtttcccttgctgggttttacccgccatggtggagctcgctgtggtgatggttcggtgtttacgtctggtttactgggccgacggctgacattcctggagagaaccaggtgggccgtgcccagcatgaaccagcacgaccctgacaagctcctttcctggggcagccctgcccgccgcgcggccgtactcaccaggaaggcgcagtccactctgggggccgagccgttgctggggaggaacttgacgatctagaagggaaaagcttgagcgtggccgctccccacccccaccgccatgtgaggtgcacggcacccacccatggagctgagatctggccggccccagcctgggctttctgaccaggactgagaagggcccttggtctggtttgcggcttcccttggaggaatccccataggtgtcactaactcatcattcagagccacagccctccccccacccacccatcagcaagccacttggcccaggcttcaggaggcggctggcaggaggcagagctggggcggggtggtcttagccctcgaaccatgtccaggtccggtggagcactgagacagagcacgggccggcctgcctcctgctctgcacagctcttccagaaaactctctctggcccacccgggccttcagcccccttccccacacctcttccctgggcttctccagccccagccatcccctgctgtgctccgagggtggcagctgccatgagacgggcacagtggccaccacgccctgctgggacccccgtcacagcccctccatgccggcagtgctgagaccctggctgacggggacccgtgaggtgtagagggcacaagcctgcagcctcttaagtggaaaaggaacagcacagctgcccggaggcccagcacagagctgctgattggtccatggagtggtggccccaagccctctgcttggccaggacctgccctgctcgagcctggctcagggatcacctccccacaccccctaaggggcccctggtcccaggttggaagcctctgctttagaaggtgctaaacccctcccaatcctgactccagaacttgaggcccctttacctggccctggcatctctggctgccctgaagggggccctggccttgcagagacccctgttcaaatgtttccacatgttttagagggccggctatgtgctggtgtctgacgagtggtttcaaatttgtatctaagaaccacacgggacaggtgcgtgccaaaccaaggtacagggtggtgaggctggagtccctgtcccgcttgggcaagccccagacaggacacctgtgctcctcgtggtgggtgtgggtgagaggccctgactgcactgttgtagtggcgtgtgaaggagaccctcagtactcaccctgttcattttaataataaaacatggctttccttcttcaaagccgaagttgggatccgccaggcctgagcagttctgcagcatatctgccgtgaacttgcaggagaacttggtgtggttgggagcgcggaaactctcctggaagaagtactgctcggaggtgcagttgatgctgtcctcctgggctgctggagagtagcctgcagacggacgcacctgccagccctgtcctgccctggccctgacgcctggctgccccccgggaaggccttgcaagccctgagtgcgagtttctcatgaaatagaaaaggccgaagctgtggagccgtttcacacctcacctgctgcttcacacctcacccacccgccgcttcacacctcacccacccgccgcttcacacctcacccacccgccgcttcacacctcacctgccgtttcacacctcacctgctaggaaggcgtggagagtctgtgtgaggtctgcccaggttctgttatcagagacgttgtagacaatttccaggcctttctccccgtaaacatccggccttaaggttacccctggagagagagacctttgtgcttagcgtctccaaatgctcaccacatttaagccatcagttctgaagtggctgaggatacgccagaggcggtggcccaacccaggagcctcctcggagtaaactgtctgcagcacaggaaggaaggacccccaggacagcacagtcagaatgcagcctgggtccctgctgggagttgccccggccctggaacctggctggctgccatggtggggggtggggggtggctggctctctccaccgggtgcctgctctgtgacaggtgatgactaatccagaggctgcacctgggtttctatgtaaaattgcatttgaacatgcattaaaaaaaatcttcactggttttggttaagaacaaaagcagtctaacaacatgttaactgtaaaactgaacatcaggatgcacacagcggggagtgaaacgcagagccgtcgactttcccgatgtgaaccgtcaaatgtgcatcctttgcacactttcctgtttctgtggaaacacagatgcagaaacgtgtgtttactgcaggtccttaggaacagcccgccatccacacaccactggcttcccagtggccacacacttccacttcccgtgcgattgggagcctctttttctgtcattttgtgtcaactcacctcattctttccataaatgtggtttcattgtgtgaagcctgcagtttgcttagttggtcccctatggatgcagctggctttacatttgaggctaggtgttgctgtttagtggattttgttaagagtaaaatctatacgtggtttaaaataaaaaccttcagcagggtctgagggaaaaggaggttctgcacttgctctgcacaccgatggggacgtctgtcctgtggcctctgacgactcggatgcctgttcctctgtccttgcaccctgctgatgtgtaggtgaccagcgggctcttttctgctggtctcccgggtgtgctccttggaaactgtttcctgtgcgtccttgcagaaacattccgtgtgcatatccaagcacaggaagtaagtggatggaaaaactttgtctctataacaaaacccttctgtttcataattaaaactaaagccaaagtcagattttataatttggagtcattttcctcatggaaagaaactaaggggccgcttatgccttggtgctgctcttaaagccggttcaggggccaggggctgccctcgggggcacctgctggggtgtgtggctcaccctggggctgccgggctggcttccctgggcttcatttctggggagggcacgggtcccccgggcgtctccagagccgaggaggcggcagcctggcctgtcacacggcatgggggcaacatcccgggcgcttacctggtgaccgtagctggtcttggtagtccggtgtgtacgggtccactgtctgcatcagcacatagaggcacagggcgaagagcccagtcatcaccacgtagaaggccacgtagtacaggctgatccacactgcgacacaaggcaggcacaaaatttaccacgtcagccattttaacgcacacaattcggtggccttgagcgcgtccgtgatgtggcgtgaccatcttccctacctagttccagaacattctcctcccccaaaacagaaaccccgtccccacaaacagtcactacaatcccctcccagcgccgcaccaccggccacgttctgcctctgggtttgcccgtctggacgtccacataggcagaatcctgcgacccgaggcagttgcacccagctgccttcactccagccgctgtttgagatgtggccgaggatgcgccaccaccccagctccagcaggaaccgagggccctctgaggggggagttatggttcccccatcacaggaagggaaactgaggcagagaggtggggtcctgcccatggtgacccatagtgcagcctggaagtgcatggccggtcctgcttccacaaagacatcaggaagagaaagggaggaagggaagccctggagatggctcttctcagaagcaagggtgtccataggcaccggcaactcagggtgcagcttcatctcatctgcttctgagaccctcctgtgagcttcccctgcagcgtcagaacctaacggaagccaccgtccccgtggccatgggcggctcctggacacaggcgactgcctgtgtgctgtcttcgtctctgtaaattagcttgtgtggatcgcaggaggcatttgcagggagacaccggcaggaagaggacggttttgtgtttgctacggcttttgtctttctggaaagtctgtaatgaactgggcctcctgctcctcctctccgctgatgtggcatggattctgcttagtgagccgttctccagtgacccaaaacacaaccaaagggcaggaccaagtcagagaagcaagggagtgcagggccaagaggccagagccctgagctgtgatgagaggctgtggcctgtggactgcctgccctcttctgtgagctgggacagcacagatctctgagccaggtcccttcagcaccagctgggctcagggctgggtcttgctcacctggcatccactttgagtccctcctttccccgccgggcgtccctggtgacggcgttcttgtgtggccacagcagcttggcttcagcctccggttttgagtttccagcttcagcagtgtggggcccgcagtggtggagggtttctgtcctgtcactggatcacgcctggtgcctccctggtgctggccctgcaggtcctgcctcagtgtccccaggtcactcctgatgtggcttctatttgacttggccgcctgtcccccggggacctacgctcgtgacggcaggggtctctgttcccccgctgtgggtcctgtgggtctgctctggggcccgtggtgcacagtggagatgtgggcggtgcgtgtctccccagtggctgctgacccactctgtggcgagtctcagctccaccaggcggctcagccctgcctcccgggtaggagcccgaggttggccaggctgggcccaggctcgggagggccatgctccctgcacttcctgggcccccgcttgcaccacggtgttcagggcacgctgcagtgcacaggggaggggttgggaggtgactgagagtcccattcccgccagctcctggggccggccgggtgcagctcactctgcctctcctgcacctgcacccgtcccccaattagtaagaataacgtgtcctattccttttgtttttgtcatttcacttgagttgtgttttcctggggccctaagactttcttatcccaaacggaggccatgtctaccggccaggcagtgagaccattccagaaggttctctgtggccctgcagccaggaggcggcacatgggagtctcagcatctagaatggcccaaaagatggggcttccaaggacctggccggcagcccccagcccagcccccgccctcagctccttccccatcctggcctcccgctctgccgccccgcctggcccaggaggcccttctgcccccggtccctgcctctctaggaacggggtatttgttctacttcaaatgcgcccatgactccagctggctctggtgccctttgagaccgtggagcctccagcgggggctgcagccttcaccagcactgtggtgagtgtgggggatttggcagcgtgtcacgggcattcccagcacgtctcagctacacacacaggtggggcgggcctggggctttgcattcccacctcggctctgggacccccagagccgggcaccgtgggaattgaggagggcctgaccttccctgggagccggggacggcaccaggccagccagttcagccgcatcccgacgcccaggggtcgcagggggaggtgggggcgcacaggtgcttcctccagactctctcataaggggtgagggcgtttcccggaacgggtgtggcagccctgatgtagacgcagacgcttccaccacctgtgtggccttggaggcccaggcatctgctttcctcccaggagggccaggctgcccgcgcctctgtgcagccacggggacaggaccctgcagggcagacctcgcacaaggcgcaggtgctgcaggctgaggcaggcctggtttactccccacctccgcatctggacgccagcgggtgtcccggaaaggggctggcagccgcgtctcggcagagccccttattcaggtcattgcgtgaatctgtgtgaccaaggaatcaccgttgccacctttcacgttattttcaaaatgattcactttagaaacatacttttaaaatgctgttctcagacatacggctgacatttggggccagtctgtggacgccctccaccggcgttctgcagctggggctccaggtcaactcagccttcaggatgctctggggaccctcgctttccctgggaggcaagtgaggccctggccgaagcccgtccacgccatccaggcagcatcggggtctcactgtcaggggccctctgctcccctcctcctgagctcacctggaggctgcgtcctcagagcggccccctccatgcacccagccggcccgccccccgcacgtaccccacctggacagggtgcggcccagcatctgccccgtgtccgggttccagcagtaacgctggaactcctccatgcgctggccacacgtcttcttctcctgcagagccgccatcgtccctggcctgagatcctcccgtctgctccctgcaccctctacgcccagactgaggccagatgcccacctctgggctttatagtttcctctgccagaggtcaaaggcatcgcaggcgaaggatcccagggagaggccagggccgtttatcagcgccggccatcgcctcaccaaacaccaggggctgggtgcagcccggctgttgcccctggggcgggccaggcccgctttcctcaccctgctgctcttgggacgcccttggctgcagctttgtctgctctgattgcggtgagggcacgttccggggtgagcagcactcacaggcccttccccttccctcctctccttcaggagggagattgaggtcagagcagagccggcctggacccactgtgtccacgaccttgggctgagccagctggggccgcatccctggcctgggagggcgtgaggcaggcgagtgaggggcgaccggctccctgggccccccgctgcggccgccccgattctgggtcacccagtggaagggtgagcctggcagctggagctgggttggcagggaacacaggggtccccggggactcctctgcctcccagattcacccagagcagcaatagcctcttagatccccagagggcagtggcaccgagggccctttaggatttttttgtgtccatggaggaattcataaacacaaacccctaaatctagtggtcctcaaaatgaagtgcacaggagccctgagcatctgttgaatgcagattcagcccagcgagtcctgtgggggccccagactgcatttctaacagtgctggtgggagggagtaaggcagggtccaggtgggggatgctcagcctgggcagtacctcggggtcaccgggggtccgggcagtgcactggggtcacagggccggggcagggaccatgaagtcatcactgcccacttccgcccggagattctgcctgagcctctcgcccatgggtccgagcaccaggacgtggagggctcccaggcagtcttgttgggcggcgcacttcagaaccccggctcagacgctttgctgttggagacaggggtcctggatggcagatgccattgctgcctgctggctgcagtgcccatctctgcaggaggttgatgggaatgcagggcaaatgaaatgtgctcaggggccttctgacaaatatgattcgaagtcgactagccctgtgtgtccagaattacatgcagagtttcccatactgtcaactctaggccgtccctctcagggacccgtgtaaccaaattcatttcttagaagaaacaaaattcctctaggcattacgctgctttaattttttaggataatttagagtttgcaaaataattgccctaaaattcaaatggaatgatgtcattttagcctggattcctatcatttcttttcttttttttaatttctaatttttatttcttttatttttttgtagagatggggtctccctatgttgcccagactggtttagaactcctgagttcaagggatcctcccacctcggcctcccaaagtgttaggattacaagcgtgagcccctgcgcccagccataatttcttaatggacctatccttcctttaacattgtacccatttctgactttggaatgttagggcgataagaacacagggtctggcagtaaaggccacagtctgattgttcacagactgtggccctgggaccccagagtgccaggggtctgacaacacctggatgcagcaactgttgtctgtgaagggtatagatgctcttgaaatgaacaaagtatgaattatttctaaacatctttgaatttagtcttcctaatgtagtctctgaatttccagaagcaggtacatgtgctgagctgtacacatgttatcagaatgaccttcttctggacacatacgtgtggggaggagggccagagaccttggtagagggcagtttccccacagcatgctctgaaaacatagaactaggtgctctatacaaattgggtgccagacaatgaggggggcccagaatcccacccacatctggcagccaccggtcacccctctctccccccatctgagtggtgtcagacacaacgtagtagaaagttaggactgtgaccaccacacagtgacaaggccacctcccactgtggtgtcagtggagaccatatggaaagccaggactgctacccacccacccaacagtcctcaggagcccacccaaaggttcccagtgggaaacctagacttctggccccacatggtgttaacaaggtgaagcctctcccttttgctgctgaagtggggtcagagaaagccagtaaaaagagaaggattaaataatatgaaaacgtctgggtttcagtagataaccactcatcacacaaagaacgaggacgattttaagatgaattaatacaaagctgggtgttttggctcatgcctgttatcccagagctttgggaggctggactgagaggatcgttttagaccaggagttccagaccagcctgggcatctctgctaaaaaattaaaaaattctaaaaatgaatttaaaaagacaatatatgccaacaccaaggtgacagagatgttaggattagctgccaaaaattttaaagcagccatgataaaaatgcttgaatagcaattacaaacaagcctgaaacaaatgaaaaactagaaagctgcaaaatatggaaagcaaactgatagaactaaaagtagacataaacacatccacaattatagttggagatctcaacactcctctcttaacaattgatagaacaaccaaatagaaaattagcatggatacggaagaactcaacatcatcaaccaacaggatgtcattgacattcgcagaatactcaacagagaatacacattctctttaagtccccatgaaatatatatcaagataagctgtatcttgggccataaaggaagtcttagcaaatttaaagaattcaaatcatacagagtatgttctccaatcacaatggaatcaaattagatattaataacaaagataacagaaaaacctccaaatatgaaacctgaacaacatacttctaatactcatgagtcaaaaaggaagtttcaagggaaatttaaaaatacatggaactgaatgaagaaaaaatacaccatataagaactcaagggacatagctaaagcagtattaagaggaaaatttatagcactaaaaatgcatattttagaaaagaggacaagtctcaaaaaccctaagctctcatctcacaaatgtagaaaaagaaaagcaagtaaaacaaagcaaaagcaagcaagcaaacaacagcagcaacaaaaacaagcagaaggaagaaattaaaagataagagcagaaaccaatgaacttgaaaatgcaaaagcaatagaaaggactagttctttgaaaatgtaaataaaattaataaacctgtagctagagagaaggctgagataactgatagcaggaataaaataggagctatcactacagaccctgcaaacatcaaaaagataaggaaggaaatacttgcgcaattctacatacataaactttacaacttagataatgggctgcttcatcaaaaatcacaactcacccgacttcaaatagataatgtaaatagcctataactattaaggaaactgaattaataatttaaaatctcccaataaagaaacctctaggcccagatgatttcatgggacaattctaccaaacacttaatagagaacaccaattcttcaccatcttttggaaaatagaagaagaggaaatattttccaactcatcttataagaccagtgttacctttataacaaaatcagacaaggatagttcaaaaaagagaactacagatcaatatccctcatgaatatagatgcaaaaaccataaataaaatttggtaagttgaatccaacaaagtataaaaagcaaatgccatgaccaagcgggatgtattccaggaatgcaaggctggttcagtattcaaaacccaatcagtgtgatccaccacattaacaggctgaagaaaaaccacacaatcatatcaatcagcaaagaaaaagcatttgatgaaattcagcttccatgtgacaaaagctctcagcaaaccaagagtagaaggaagcctgttcaacttgattaaaagcattgacaaaaaacccacagctaacagtatgcccaatggtgaaagatgaaacgttttttaccccaagaccgggaacaagcccctcatttttatccaacattgtactggaagttctagctagagcaatgaacaagaagaggaaataaaaagcatgaatatcagaaaggaagaaataaaactgtccttatttgcagataacatgaatgcttatgtagaaaatctcaaagaatccataacaaaactcctacagctgttaagtgagtttagcaaggtctcaggatatgagatgaaggtgcaaaaatccactgtacatctatatactagcaataggcatatggataccaaaattaaaaacacaataccatttatgattgctcaacaccaagaggaatatttaggtgttaataacaaaacatgtacaggacttgcatgctgaaacccatgtaatattgatgaaagaaattagagtttgaataaatggagacacacactatgtttgtagtgtggaagactcaacataacaaagagatcaatctccccaaattgatatagggtgcaacataattcctatcaaaatccagacacaatgtttttggtagatatatacaagattattctaaaatttatatagaaaagcaaaggaactagaataagtaaatattttcttgcatattttgaacatagggttttttaaacattttttgaaattttttttgaaaaacaagaataaaatgggaggactcagtctacccaatttcaaagcttattatgtagctgtggtgatcaagattgtatggtatggtcagagggagacacatagatcaatggaacagaagagaaaatccagaggtggacccacacaatatgtgcaactgatttctgacaaaggcgcaaaaggaattcaatgaagcaaaaataaccttttcaacaaacagtgctggagctattggatatccattggccaaagggggaggaaaaagaccttcaacctcttaaaccttctataaaaagtaacccaaagtggatatgaacgtaaatgtaaattgtaaaactataaaacttttaggaaaaatatgggagaaaatcttcaagatctggggctggacaacaccaaaagcacaatctataatatttatattcaacaaaatttaaaacttctgctctatgaaagcccatatagaaaggaggcaaagagaagctatcactgggagaggatattcgaaaaccgcatgtctgacaaaggactgctatctgatattgatagaatctcaaaactcatgacaggaaagcaaacaatccagttgttacatggtcaaaagatgtgaagagacatttcacccaagagcacgcacagatggcaatgcacacatggaaaggtgttcttccaccattagggaaatgtaaattacaaccgtaagggaatactccacacctaccaggagggccaaaacaagactgtggcagcgctaaactctggggaggatcctgaggaagaatctgctcaccatcgctggtgggaatgtaaaatggcacggccactccagaaaacagcttgccggtttcttcaaaactaaacgtgcaattacgacacttttaggcatttaccccagagaaatagaaacttctattcacacaaaggcctacacagatgtttatagcagctttatagctaaacactggaaacgatccagccgtccttcaaccggtgaacggcgaaacggactgtggcactctcctctgtggagcacaccacagagacgaggagggaatggctgacacctgggaacagtgctgagtgagaaatgcaggtcctgaaaggctacatagtgtctgactccattcatgtgacgtgcttagagaagtcgtggttgccgggcattgagcagggcgggctgggggaacttcggtgcatctgtgagcagcacaggagggtcccgtggatggaggcggcctctgtctcagccatatggatgccaatatcctcgctacttggcaagatgtcatcattacaggagacagagttaagggtacacaggatctctctggattgtttcttaacatggcatgtaaatccacaattatcacagaataaagagtttaattaaaaagggattttcagggccaaatgaatttgggaaacgacatactttacttctctttgagagacacgttcactctgaaatcactgaataaaccctgtgatggacacgtttcacatatttttaactttgcttgtttaacatatttaactttatttaaccgaacgcttcccaacatgactgcaggtggaacggcccccagtccaacaggaagccatcctcctcagaccctacgcctccacagcatcagcaccacctgtgagcttgttacaggtgcagtcttggcccacctggccactgaagcagactctttattccagcaaggtctccgggcgattcatgtgtgtagctgtttgaggcatgaaccaggacaggcagcgagacgtcagcagagacggctacacttcacaaagcaccacagttgccccattgggtgagcaggcaggaaggagttaacgtgatccgcccaaggtcactgctgtgaagggcagggctgggcccgtgcagggctcctggtgaacgatgggatatcactcacctcaaatatttactcgtgatccacctgccaaagccctcaggagaccgtggggacgtcggctcggtctgcgggccctcgcttcggcctctgtagaccctgccaggtgcagcccccagtgccctcccacagttgcctcttctcccacgtggaatggggtgggctgacagtctccacctctctatgctccggcattcttcctttctgcgaccctttgcttcctccctgtgtgagctggaaccaatcccctgctgaattcctcctcattcttctccaaacctttattgagtacctactgtgtgctggaataagacaggcagggccatgccctcatgaagctgacaatcctattggtgtgaccatccccaggtgtgtcccaggtgtgttgcaggtgtgtccgaggtatgccccagctgtcccaggtgtgccccagctgtctcagatgtgccccagctgtcccaggtgtgtcacagctgcattgcaggtgtgccccagttgcattccatgtgtgctccaagtgtgtaccagctgtcccaggtgtgtctcaggtgtgccccagctgtatcccaggtgtgcctcagctgtcttaggtgtgtctcaggtgcatcccaggtgtgtctcagatgtgccccagctgtcccaggtgtgccccagctgtcccaggtgtgccccagctgtctccagtgtgtcccagctgtgccccaggtgtgtgtcctaggtgtgcctcagctgtctcaggtgtgccccaggcatatcccaggtgtgccccagctgtcccaggtgtgtcctacgtgtgcaccagctgtatcccaggtgtgccccaggtgtgtctcagatgggtcccaagtgttccccaactgcatttcaggtgtctcaggtgtgcccaagctgtcccaggtgtgtccaagatgtgccccaggtgtgtctcaggtgggtctcaagtgccccagctgcatttcaggtgtctcaggtgtgccccccagtgcatcccaggtgtgtcccaggtgtgccccaggtgcatcccaggtgtgtcccaggtgtgccccagctgtctcaggtgtctcaggtgtgccccaggcatatcccaggtgtgcctcagctctcccaggtgtgtcctacatgtgcaccagctgtatctcaggtgtgtctcaggtgtgccccagatgtgcccccggtgtgtctcaggtgggtcccaagtgttccccagctgcatttcaagtgtctcaggtgtgccccaggtgtgcccccgctgtcccaggtgtgtccaagatgtaccccaggtgtgtcccagctgtcccaagtgtgtctcaggtgtgccccaggtgtgttccaggtgttccccagctgtcccagctgtcccaggtctcaggtgtgccccaggtgtgttccaggtgttcaccagctgtcccagctgtcccaggtctcaggtgtgccccaggtatgttgcaggtgttccccagctgtcccagctgtcccaggtgtgtcccaggtgttccccaggtgtgtcccagctgtcccaggtgtgtcccagatgtgccccaggtgtaccccaggtgtttctcaggtggattccaggtgtgtcccaggtgagccccagctgtattccatatgcgtccctctgagtggggccttggtttgatgtagctccggggatcttctgctccctggtcctggtgtcaccagcaactgcctcttgacaatcctgccttgcctgcaaaccccaggtgagaagaagacaaatgactgggaactgacccctcagtaagcgctggtggtctcacctacagacccccaggaagctggtcactgtgggcttcttttcctctctaaattcctattatcaggtggttttctttctcatttgctattttcttaaaaataaaaatagggaaaaacagcctttgtaaattacggtttcttccggctccatcctctccgtcaggcccacatcccaaggaaacagcaggcttgagcctggctgctgaagccaggggctggatggagcagctcagaacagagctttgagtgcctctccagccaggggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccgggctcccaggggcttcccagtggtccccaggaaccctcgacagggccagggcgtctctctcgtccagcaagggcagggacgggccacaggccaagggcagcagtcaggcctgctctgtctgtgaacgctcccggcttggcctcggctgatgggccctcacgcctgaagcgggcaggaagctccgggatggatttcgggtctttggagaccgtggtggccaactctgccttcatcgccgcccgaggcagctttgacggcagcagctcccaaccctcccgggacaagaagtacctggccaagctcaagctgcccccgctgtccaagtgtgagtccctccgcgacagcctcagcctggagtttgagagtgtgtgcttggagcagcccatcggcaagaagctctttcagcagttcctacaatcggcagagaagcacctgccggccctggagctctggaaagacatcgaggactatgacacggcagacaatgacctccagccacagaaggcccagaccatcctggcccagtacctggacccccaggccaaactcttctgcagcttcctggatgaggggatagtggcgaagtttaaggaggggcctgtggagatccaggacgggctcttccagcccctgctgcaggccaccctggcacacctgggccaagcccccttccaggagtacctgggcagcctgtacttcctgaggttcctgcagtggaagtggctggaagcccagcccatgggggaggactggttcctggacttcagggtcctagggaaagggggcttcggggaggtgtcggcctgccagatgaaggcgaccggcaagctgtatgcctgcaagaagctgaacaagaagcggctgaagaagaggaagggctaccaggtgagcagcgcgacccggccagcagggatggggtggcagggtgcagggatggggcggcagggtgcagagggcccccaggtcactgtcggctccggggcccttaacagctggtgcctaagggagcatgcatgccagcctcgccacgtgggcgccccgcggccgtgcggttacgagcagttccagtccatgtgcagaagtccctcctcggagagtgacctccacatttttgggtggggacgtgccacgttcactcgtcggtttttcaccaaccacagactagcctcaagtgtgggggaaagaggacctctcaggggaggctgaagaggggcagggtctccggattctttgccatgactgtggaagactttccagggccctggctcctctgatcgcagcgaatgcaggaggaactgaggcaggacggaggcagcctcgctctgatgacagtttctgtgaggcagagcctggcgtgacgccgggggcaggaactgttcccctgagtgtgctgtcctcgggggtgggagtgagcgacgggcacgcaggccgctctaagtttcatccgctctgcccactggcgtcagactgtgcatctggggcaggatcagcagaagctgcttacaggtcttaagggtgaggggcagcggctgtgccgggtgtggacgtgatctcctgagccagccccctgcactttgactccacgtggctcctggcccctctcccaccacgcagctgtgttgagtgcacaggaagctcttagggttaagcagcagccactgtgcaccctggctctgcggaacctcaaccctcagtgaaggtgaaataccaggtgctcacagcgctgggcggaggccctggaacatctgcgtgttctcgccgtggaactcggggcgagtaactatgctgtgtggttgtagcagtaatttttaaaaattagctttcttgacatctaattcccccaccgtgccattcacatctaactgtaaatttaacccaacattcagcctcttttcctgacttccgtcaccaaactgaactccatactgacatcaactgaacacctccccatgtaagtgcagaaaggggcctccgacatcaggaattccctcttcaaagagggatgtgctatccttatccagacacttacaaactcgttcaatggagcattgtgaggtttcaaaataaagacaaaatgaagcagagtggtgagggggtttgggaggtgctggtctgggagcccagcccacgggggcctggacaggagggagggctgtggctgcaggattgctgggcaggcggggctggcagggtcctcacccatgttgctcagccttggggcttgagcctccccttgccagaggctggcccagaagaccagaagtcccctgtatgtgaaggaattcacatgtctggttttctgaaatgggggtgcaggcatgttttgaagtcatttgcaattgctttgtgaaaggcgcatttaaagcatgtttgcgactgctccgtggctgtgtgcagtgggcgtggccgggtgcacacggtctctgcgatgcacctagtccctttcctattcaaagccagtgcgtactcagcgtctcacttttcagggtgctatggtggagaagaagattctgatgaaagtacacagcaggttcatcgtgtctctggcctatgcgtttgaaaccaaagccgacctctgtctggtgatgaccatcatgaacggaggtgacatcaggtaagggctgggccagagggcacgagggggccccgctgtcccactgggtcagggtttccagggcccgggctcctttccacaggcagagccatggtggccccaggcctgccctcgagggaagccttgcacccatcacaatccccttctcgctgttggttcctgaaacaatgcaccctggacccacatcggagcaggagcctgggaggcgcccaacctgacaatcagggctcgtcctgtgtgtggtcttggtgtgggtgtgggaggcacgtggtgctgtgggggacgtgtgatgcagtcggcggggcctctgcagggctgagggccttgcaccaggagggtaaatgaagacgaacttcaccagcgcccactcctagggctgaccctagagctggagacaagatcagtccagctgggggccgtgatcttgctgtccccaggcagagaggaggtggcgctgcctccacaaagtcctgccccggatctgccgctgagacaggccccaggcccgtgctggggatcagatcacaggctcgcttggtagctgggccgcttagccactgcgtgcttctgtttcctggtctgtaaaatggggagagataatatctgagtccagagactgtccggagattaagacaatacgtgtgaaatacctgcagtgtctgatgcccgtaaggttagcagtgggcaggggccatggctgtggctggcagcaccatgccccattctcacctgcttttaatttccaaggaaattcctccaggtgaggctggtggccccatttttcagatgagaaatgtgagtccagactaagtcaccacgcggagggggcactgggaagcgcagacacaggggtgtccaggcggaggggagggggcgctgggaaacgcagacacaggggtgcccaggcggaggggagggggcgctgggaaacgcagacacggggtgcccaggcggaggggagggggcgctgggaaacgcagacacgggggtgcccaggcggaggggaggggacattgggaagtgcacacacagggttgtccaggaggaggggaggggtgctaggaagcgcggtcacaggggtgcccagggagggcctggtggctctggccgccttgtggtccgcctggctccagggcctcctctcctgtttcctgtgacgatactcctggtgccacctcgtttaaattatttcttgtttaaatcatttcttttatttgttaggttttgcttctctgcaaaacctgtccgtggaaaacataagagatgatgttctatgggggaggaaagaggctgagaagaaacaccttactgcaaatctttcatgagtctgatgaacttggggcctgcggagctgcatcccacctcggcctcggcctggccccttcctgagacggtctgggctgtttcctagcacctgcggcccgcgctggaaagcaggcggacaggagacgcacgtggacagcactttctccctgttagcagttggggttcagggtccctgagctgctaacgccgccagccaccatggccttcgggtgtcctctgcagggacgtaggggggccaggcctcaaaacgaccagaacgctggccgagagacatggttctgaggccccagctctgtctttccatgattttactccccattaaacccggggtgcatggttcccacgtgtcttcccccaggtaccacatctacaacgtgaatgaggagaaccctggcttcccggagccgcgcgccctcttctacacggcgcagatcatctgcggcctggagcacctgcaccagaggcggatcgtctaccgcgacctcaagcccgagaacgtgctgctggacaatgacggtaggaggtgccctcggctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctaaaatggagacacaaaggattacccccctttattctggagctcaaaatatgcaacttcccaactactcccgcagataacgtcactacggtggaacctaagactggcctttgagatgtcttttcaggttttttgcaagtctgacaactgatttccccccctggaccggtcagcctccctggtgccacccagaagcgactcggggcacaaggaccatttcccacaccccgacgactgcacccccaaccagtcagcagcaagcgcccttgcctacccacccgactctcttcccctaaactagccttgagagaccctggtctctgcattttcagggaggctgatgtgagtaacaataaaactctagtgtcctgtttagccggctctgcgtgtgtaaaactgtttctctattgcagctctcgccactggccaggaaacggtttccccctcctcgggctgtgctgggaggaagggtctgaagtggcttgtaatgtcggaagcaaagtggaggacttgcccggaagagggaggaaggccttggctcctttgagccagtgggaatggaagggaaggcggccaggatttcctcaaaaatatttccccatagccggtcagctccccacggggccaataccgcatcctcactctgggcgcaaggacggccccttcccagagcccatttagaacttggatgaatgttctatcaacactcatggatgttgcctggatgaatgggctctatccgggccttgagtaggaagaagccgctggcagttacttgctcacccagagactccaagcagccacactcacctgggctgatgactcaattgactcctgagtttctccggctcttcattgaggtctgtcttttccacctccatctttgagcctctgaacttgatgaaaatcggttacatgtagatggcttttctgtccaatgctagagaactttgaacttaatggaatcctgccgtcttttcatcaactcagtgctaaacaactctagattttaaaatgatatccagtgtgactgcgtccatttcacatggcacaaggattgtctgtgatcacgattcataaagctgctattttttagctgacactaggcccaagcatggcccctgggggcacagggctgtttatttctcttttaaagcaccctaatctgggaggtgtattttgccggtggctggcgggctgggagcagagaaaagttcagtgtaaaaatgaaaatgcattcccggcaggaaaactcccaccctaagggcacgtatgcagtttaccccaaaacaatggttgccgtgggtaacccgagtggtgttgccagtggctgccagtttggcccttccagggagatgtcaagagaccccttctaccaatccctttcctcattaaagaggaagaatgtttgctttctgggagatatttaagaggacaatttgaaatcccacaaaagccagggttggtagaatcaggacttggctcagcccagctcagccccgcagcagctaccccgggctctgtttgtcctggcttccaccagggccagcgcttcacagccggaagcaaacaggccaagcatttcttggttaatagcacaagggggccaggcttgctggagaagcagcggtcagggccaggggcccctaacctctgcagtcgcccctcccagtggctttccagagctgttttccacctctccctgaggagctgaagggcgccgggggccgagtcactgccacagccgcagggaccaagccccatcccagcaaggctgaggcctcaggaaggcggccagcccaggccctctcgccactggccaggaaactgttccccccctcgggctgtgctgggaggaagggtctgaagtggcttgtaacgtcggaagcaaaatggagaacttgcccagaagagggaggaatgccttggctcctttgagccagtgggaatggaagggaagaaggccaggatttcctcaaaaatatttccctgtagccagtcagctccccacagggccaatacctcgtcctcactccgggtgcaaggacagccccttcccagagcccgtttagaacttgcttctcttcagactacattccctcctggctggattctggagaccataactggggcacctaccaagtggggcccgttagaggtgctggcggagttcccgtgtgaccccatcagggtggctcacagcacatctccgcagcgacacgctcaggtctggttttccagtgtgtatgcgtggagcccagcagtggggcccagatggcgtggtgaggatcaccactgaaaggcaggcctcgagcacttgcccagagtccactgtttggagggcagttcgattcaccgtagccaattagcccacagcacacacaatctttcttttcccattgagttgtcttggcaccttggttggaaagtaatttaccatgtatgtgtgggtctatttcctttatttgaaagtgatttttaaaaggaaaattgcaagaccccttcttctaattgtggccccacacccttgcccatgcatccgactcatctccatccatcctgtgtgtctggtagtttcataaaaagtcaaacacatacctgccattatgacccagcgattgtactcctgggcatttatcgcagagaaattaaaatgtatagtcacacaaacgatcatagcagctttatttggaacagcgaaaacctgggaacagccccattgtctgtcagcaggtgcgtgtccgacgcatcgtggtgcctccacaccacacaacgtgctcagcaacggagagaaacagactctgggagaaaactccatctcaaaggctgcattccgcactccgttcccataacactcttgaaaggatgagtgacgccggcgggtgctgtgggttagagaagggccccgcggggcacacctcacacctgtggggatggacggtcatgcatctcgaatgtggttgtggttacagaaatccacatatgcggccacacatcgcagaatctccacacggagtcgtacccagaataaaacaaacacacggaaacctaggatgtccaaatgagctccgtcatccagtgacttgcgtggtgcccatatcagtttcctggttttaagaatttgttgtagctctgcaaagtgctgcattgtaggaagctgaggaatggaatgtgggacccctctgtactattcggcaactttttgtgaagctataattagctcaaaatgcaaagctaaaattactgaggacttagaaataaacttgacaaaagatttacaagtcctatatactgagaactgagaaacatcaatgagaggaatgaaaaaaggcctaaataaatggagccatagcatgttcatggaagatgccaactctccccagattgatctccagaatcaacacaatcccaatcagaatcccagcaggatttttgtagaaattggtaagctaattctaaggtttatacagaaatgcacaggacttggagtaaccaaagcaagcataaaaaagaacagagttgaagaatttatattacttgattttaatcaagacagtcaatataatcattataacagataaataggtcaatgagacagaacaacacccaggcctactcatctatggccactactcatttatggccaattgacttttgataaatgtgctgaggcaattcaacagggagagaataaccttttccacaaggaatgctgggtcatttggacacccataagcaacaaaataaaacaattacaaatcctcaaaacccttacctcacaccacatacaacaattaactttgggctggatgcagtggctcacacctgtaatcccagcactttgggaagctgaggcaggtggatcatttgaggtcaggagttcaagaccagcctgggcaacatggtgaaactctgtttctactaaaaatacaaaaattttctgggcatggtggcatgtgcttgtaatcccagctactcaggagactgaggcatgaaaattgattgaacctgggaagtggaggttacagagagccaagaccacgccactgcactccagtgtggctgacagagcgagactccatctcaaaaaaaaaaattgtaataggtcataaatctaaatgtgtgaactaaaacagtaaaacttgtaagaagaagataagataaaatcatggtgacttttagtttgggaaaggttttttaaatagaacacaaaaagttcaaactacatgaaaaaaccaataagctaaattttattaatttaaaacttttgccctttaagagacactataaagaggcaagctgccaagctggagaaattatttgcaaaccatgttcaaaaaggacttctttctaaaacatgtcaagaagcctttcaacacaataatgagacaaaacaattcaattaaaaagtaggcaaaatatttgaatggatatttcaccaaagaagctatattaacagacagaagcacgcaagacgatgctgacaaccatttagtccttagggaagtgcaaacgaagaccagtatgagaggtgcctacaaacccaccagcatggctaacatgttcaaaagtggccctgccaagggctggcgaggatgtggggcaactggagcgcgcagcatgttggcaggatcataacacaagaaccacagggaacggttcggccatttcttaaaaagctacacagagtcaccatgtgacccagacatgtctgttctgggaacgtccacagaaagactgtgtcgtaaacgttcacaacaaccttgcctgtaatcaccaaaatccaaaacaacctgaacgtcctccacgggtcagtggatgaaccaattatgatacacccatgcaactagtgctccccagcattgaaaggatgaattgttggatgaatctcaaaataattacactgtgagacaatgtcaggcaataagagtatacacgctgtgttacccaggacagaaatgaattaatctacagtgacagaaaggtcagtgtcatcagaggagcaggagggtggagggacggggcaggggccagcctgggggaggggatgtccatggtctcgattgtggtcatggctctgtgggtgcagcagaatgtcaaaacttatcaaaccgtacgtcttaaatatgggcatttaattgcatgtcaaaaaaatctaaacaaagctgaaaatggacaaaataccacaaccaatgacatctgaccgtaaagagatggatttaggtagaaggaagaattctttaacacagaatatgggtctctgagggaaatgttatctcgtaattttctcacttttggtgtatttaagctgtaggacaaggagtgaaccctaacatttggtgagagtctgtgaaacacactaggaacccccatgctgcttgcgagttacttccgagaaacagcagaatgtcacaccctgtcacccgcaggtgccgtctgaggggcgctcatccccaccagcccgagggcctccccgccaagggaggggtgtactcccttccacttggcgtctgcttgtgcattgcccctccctgaactcaagacctgagcctctctcgcctggactatttggaaagtctacaaatggaagaaggggtgctctcactgagttgtgtccgcacaagggaaactgtccaggagccacagaagcaaccgcaaagtgagcctctcagacgtggttaaagggaagccaggcaaaaagactgcacgctgttgggtttcatttactcaaaaccctaaaacaggcagaatgagtcatctgtggtaaaccagcattggggttacctctgggggccgggagggaaccctggggtgccagtcacgtctggcgtctcggcctgggtggtggggatggctcgccaagcctgtttgttgcacacgtggcatgtcagcagaaacacggggcaaatacacacgtgaacacaagaaccccgggtccctccctcatctacccagcgaccctcagtcaccccagccggctccctctcgccacccacgggctttctgtggaggccccagcctggccctggaggccgtgacccaccccgcctcttgcctgaggtcagcccaagagaccttcctgtcttcggcctggagaaggagcggccgccaggaccacccgggcctcagctccctgggagggcccctggaggaccggggctgctaaagtccacgggcatcaccgcatctaatccaggccctttgatgtgggtgatgttgatactcccactttacaggtggggaaaccaaggcttcagcttccgtggccaggggatgaatgggagtgtggtctggatggtggctcctggaccggaagcatgatgggagccatgaggaatgcaggttcttgggtccttccagctctgctggattggatgctcgtgggggctcagggtcaacacaaccccccaggactctgacctgggaagtggagcagcctgatttggaggcgaggacacaccaggaggcaccttgccctgtggccactgcactgaggcttgagagatcactagagacagctcagcctcagtgctcccgcgcccccgcctcggtgctcctgcgcccccgcctcggtgctcctgcgcccccgcctcggtgctcctgcgcccccacctcggtgctcctccactcccaccccggtgctccttccacctctgcctcacccgatggactgtgcctttgcgtttcttgtgcacaaatcctgctgaagtctgggcagctgtgtgtttgatgatgggcttgtaggagagaagcatctggactgcgccgtgcagatggcgcttctctccaggcacagtcacattcctgggaggttcctggaggcctccgagcctcgtgcagacccaaggctgcctcaccaccatggccacagcccagtgctggctgccgggcatcaaatctgcagaaatgcacgtggcataaaagcaccagagacatccgtccagagccgagggctcctccctggcccaacattttgtccacgtaagtccactttttggctgctgctcccaggcctggcaagaacgcagatccccacagcctcctgctccctggcagcctgaggacagtgtcgtaggcctgggatcctcgggcagaactgaatgcagcttttccattggagggcgctgggcccacatggcaatcacaggtatggcagatgaactcacgggatgctccgggactccaggggcctcaggagaaaggcccactggcagcgggttgcccagggctccagaggggggctccaatgtgaaccagttgcttgtggcacagcgggtcacccaggatggccctgcgtggtcagtgataacaggcagtcactcacagcgcgacttcacccatggtcactcccggtgaccagcactgcacagcctgggctttcgtcccacatggcacctccctgtccagccttggcccaagtgcctgggaaacagacagggcaccgtgtgcctgaacacactcggacagtcgaggcccccaggagaagcaacaggcaatgactcggtccccaagaagctgagcctgtccttgctggggtctgtcatctcctcttagccccgccaggctcctgaagctgccacatgtgcagcgggaggtgggtggtttgggagcagagcgaggctctggatggacgggctttaccaccagcagccaccaccacctgctctgcagggcctgggccagccctgaggaggtggcagacggaaggaggggcagcactgcctcaggtctcctttactgtcttccagacatcagctcagggagagtaggcatgtagcactgagaaacagggttgctccccatggctgcctctgcttccctgccgcacagtgtctgtacacggcctggggacctgcgaggccagaccgcagggcaggggcccacggctgtgccagcttctctcccaggccgtggcggttattacctcctgacttggcagagcatccggctactggagcccattggttccggccagtgcagtcaggacttagcttcccagctgtgatctaaatcccagcctcccaaaggcacagcgcctaagttctcccctgccaagctcacagccttctccttggcaggctgccctttctcctgctggaccaaaccaaggagcacggtgacccagggacaccacactcggtgtcagcctctgaggccatggagccacgcagacccagcacaggattagaaacagaccttcccgggaggcagagagccaggcctcctggtttatagcatgacaaggcagcactcaggaggacgcatcaatccttctccatgtcagcacctgtgactgtgaccactggtgaggtggacatgcttctttttccattttacagatgaggaaactgaggccaagggagggtcagcagcctgccctgggctgactggtgatgcagcgagggtggggtgtgggagggtggcggcggcccttgcagtccctgggaacctgcacctcttcctgggcgctgttcccctctctctcccaggacccttgggcctggcgtttcttcacctgcgaccatccaggagctggacctgccctagggcgtcagtttccagggaagcctctggcctgtgtgtgagcctccccacctgcccggccacggcctccacaggcgccctgcgcagccccgcccctcctggggcaaaggctttgcgaagactttcttctctggctcatccctttaaggaggcataaaaacgaaccccgggcctcacaggtccggaatgcgcccccctccacgatgggagcttcttggccttggctgtgcaggggccgcggctcctgggggtctggccggatctgcagtagtgctgaatgagctgtggccaggaagacgcaatgaataattgtcacttaaaaggataaacagaaattccatttcccttttaaatacttgaacatttcaaaacatctggaggacgcgatgcttttccttccaagcatctccgtggagttttgtgggttaccgcagaggatcggcagcattcctctctcagggaaaactggcctgagcattgcataacgcaggcagactgcacccctcacgtcgcctggggccacatgcacatgtttccaagagacttgctggagaatcttccccggatcttgacaaagttggacatggaaagcacgttggtccatccaaggtccacagagcgaccctggctatgaaaaatcatcctccgagtgggagtctgtctgccaggagtgaggtgacaccgcacatggcctcaggagctggaaacgctggtgaattcagatgcagccaaagcttctaacttagtcacagttattaattattcttggtcttattggagcaggaaccactgccatgcatcaggccagcaaggctcactccccaccgtaggatccctgtgtagacggtcgctccatcagtgtagttgggtgtgtggagcaagggactgggctgaccctaccttccaagcatcgatgtggccttcagcagagcaggaggagatagcccaggacttgtactttgcagttgaagtgccagacctaagaaatgcaaacctgaggatggaaagagggtggagaggggggaggtgtctggattggccgtccagagcagccccagctgcagcaagtggaacttggctggctgcctcacaggcctggtggcagcgtccccagcgaggagcctgtcccacatatgaaggtccccatacccttagcccctagctgagagtttcactgaccagagctccctgagtccagggctccactcaagggactgctgtccccgttggtgaagaaggcctgttggggccaatgcttccccccacagggaagcggagctgtattttgtcggacagaactttgcaagcctgaaacagctggtggtggccccagagccaagatctgacctcactccagagttgaagggcacagagaaggcacagctagaggcggcaggtacccctcaaagctctcgggagagggtacaaagtgggacctcccagcacccttggcctccaggcctcaaaagccctgagagggctgcatgcaaggagacaaagctggagaaggatgtgggaggcaggtggctaagaagacaggctggaaagggacgtgggaggtaggtggctttgctctaaacagaatcgtctcagtaatgtgacactgcacatgtataggtaggctcgctcatgggcataaccctctaaaacacaccttttatggagtgaaattcacttaacagccatcttgaagcatatacttcggcggcatttgctggattcacgacgttgtgcaacctctgcttctccagtttcagaacatttcatccctccagaacaacagctcatccccattaagtaatcactcctcattccttccccatcctctggaaaccacagatctgctttctgtctctatggatttgtccgttttggatatttcatataaaaggaatcacgcggtgtgcgaacgtttgtgtctcacttctttcggtggaagccacatttccaagcctcatcccagtggtggcccctgagtcccctcagtgtatcagtgtctcacttctgttcacagatgcataatatcccaccccagggaccgggcaccatttgttaatcccttcacctgtggtggacacccggtcgtctccgcctgccgagaccagctcggtcagggagaccctaacccagcggcgctagaggaattaaagacacacacacacacagaaatacagaggtgtggagtgggaaatcggggctgacagccttcagagctgagagccttgaacagagatttacccacatatttattgacagcaagccagtgataagcattgtttttatagattatagatttaaaggcattctttatgggaaataaagggatgggctggaaataaagggatgggtttggctggttacctgcaggaggagcatgcccttaaggcacagatcgctcacgctattgtttgtggattaagaatgtctttaagcggttttccgccctgaatgggccaggcgttccttgccctcattccggtaaacccacaaccttccagcgtgggcgtcatgaccatcatgagcatgttacagtgctgcagagattttgtttatggccagttttggggccagtttatggccagattttggggggcctgttcccaacatccgccttccagctgttacgaaggacgtagctacgagcgtctgtgtgcgcgtttccgagggaacaggttttgtttccatggggcgtgtgcttaaggggtaaatgctgagtcccatgctaagtgtatgcctaaactttttcaggaaccaccaaagtgttttctgcagcagccacaccattttacattcccactccacattctcgcatttttctacttaaaaaaactccaggcagagggaacagaacaggtaaagaccagaggcccagtaggcggtgcttggctggagctcaccaggggctggaccagaggacacgagaaagacgggagtggaagctgatgcccagtggtggatggcaacgagggctcgggtggctgggccgtgtcgcttatgcagaggaaacggagatgcttggaaatgctttgcagaggtgagaatatggcttgttgggagagcgcttgtgtatctggaattatctgaggcctggaggagtgacaccagtgacaaagcctttgcaggacacccaggaggccatgggagttgtcaggtgggactgccatgagagagggctggagagaagaggcgggcagaggacacagcctgggagcatctgcagtctgggcagaggcggaagcagccttcagggcggtaggtgggaaggagacagggcagagagggttatccaggactctggggagaagaggcaggtcccaagttgtttaccaagaatttacattaaaataacataagctaggctgagtgttgtcacacctgtaatcccagcactttgggaggccaaggcaggcggatcatttgaggtgaggagtttgagaccagcctggccaacatggtgaaaccccgtctctactaaaaatacaaaaaattatcctggtgtggtggcgtgtgcctgtaatcccagctacgctggaggctgaggcatgagactcgcttgaatccaggaggcagaggttgcagtaagctgagaccacaccactgcactgcagcctgggtgacagagcaagactccgtctcaaaaaaaaataagctattgatgggctatatattgttaagctatagggtgtggttacagtgtccagtgtagcattgttcgattaatttatagcctcttgtggcaacagcaagcagtttccagagatgaatacacagcttgagtaggcaggggggagtaggacatgacggctgcctcatcttaacaccttgggcctgataatttaaaaggactcacagtcctcagataaacatgactttcttttctcatgaggaaacagagaaggtggctaaagggtatctctttctctcatgatcccaaacctatcaggtttttatttcccacaccacccagttttccagctccttggatgccaactggatgtcctggaattccattcaattctgagactaacaacctgggttgcagtgcaccgtcctccctcccggcatctggatgaattcaccaccctgggagtttttggaaccccatcatttaggatagacatcctaaattatgtgtacctcatggaggttccattatgtaggtgtggggccaagggagagcttttccctcagccttacaagggttctctgaaaagtcaactcacaaaaagcagattaactggagaaaaggcacacaaattaatgtgtatacaagggacccttcagataaacagctcatttttatgcttaggttcaatgaagtatgggcagccatgtagaaataggattggaggcttagctggatctgatgctaatggactgagtggggaaagccagcctggtctgtgtgtctggattctccttggcctctctgagcagcgccctctccttctgggtgtgggtgggaccctctctggaatgggggtcttaggagctacagccaagccaggtaggtcagaccatttctttatggccagtttgtacacacagaggcacagggaaaattagagccctagtttttggttgtatggctggctttggggaaaggggttctggtttctaggacccactgtggggaagaaggattcccatttctatggcaccttgagtgagagtggtactgagacacagaggatgggagaagctcagacagaaacttgcttcagaggctgctgctggggccctcattttggagtatgatcttctaagccccaacacaggcaccaaaaataacgtcctaaggcccccagtgactacatggacccgctcttggccaaggggaccccagagaaacctggaaaacagttcccggccgcaacaggaagggagattggacgcctggctgttcccactccctttggaatttaggcattaatgtcaaaacagagatcagaaggctgacagaactgaccgtggcaataagagccccagttacaaacaggacccaagaccatgtcagacgagggttaagtcaagtcatgcaccctgttagtcacccctgccccatgtttcgggtgcagatgtcctcatcgctgactctaggttttagataaagctttgctcctttaaccagccgcaaactgaagactctctgaatccacctataaccgataaggcttgcttccagatatcccgcgtgttcgagctgagccaatatatatctcgtccacctgtaacgcctgtcccctaaagtgcatgaagccagactgtaatccaggcacctcaggaacactcactctaggcttcttgggtttgttttttctccaagctgtggtcaccgtattaggggtcccaataaacctctttaaaatgttttacagagtttggtttttcattaacagaataatggattaaattcttggccatcggtaatcagttccatcttcagctcctgtcctctctcccctcccgcttcctggaggttggggtggatctgaaagtcctcacctataagtcctgccttggtctttctggggagcagtcccttcctgaagctgcccaagggtcaccagctctgtcctctcgtcagcacacaaaagacacgctcatcactcaagaggttccaggtctcttagaagctctggtgttgggaatctgggacgaagaccaaatctatattttgttattatcacaataccatggcaacagtctgcaaaccaggaagagagcctcaccagacgccagccatgctggcaccctgatgttggcctttctgcctccaggactgagcgagaaaaatgtttgtggggtgagccctggtctgtggtgcgctgttatgggcgggacccctgtaagcccagagtcagcgcttgctgcatccctgctctcagaggcgtgtggcagttgcctttccctgtggagggttgggtgagattgcccttgcactgacagcaactgaaggacgattgagggccctagatctctgggtgcagggcacctggtgaaacgacccgccacacatgactgattttcagccaaagatcacttgtagcttaccaaatatgccagaccaaaaactaaaaccaaaagttgacagagaatcttcattttacaaatggagaaatcagagcatcctaatggtgagcaacttgtttaaaaaggaaaattctgtatggctgtggatctgcggctgctgtcaaagggttgctttcagtaacttgccaataacggtggagctgttgtgcttgcttcctagccagagatcgtgtcaaataaaataaccctaattttggaattagataggttgagttcaattcctagctcctgaaaaatgattttgaacttagaaattggttccagcaatattatgagtcaagtatgaaggtagaataaagatgttttgtggcattcaaccttccaaaacatttacctgtttaaacttattttagaaagttacttgaggatgtgctccagcaaaatgaaggagaaaataaagaggaagacctgggatccaacacatagtggattcaactgagaaaagttgtggagggaagtcccaggaggagagctgcacactggatctgagagagtagcacaatgtaggctgcacatggggctcatcctgaggagacctcctggcataatggagcactgggggtgaaggcagatagaagatagtcgggagactatgaacacacatgagaatgtgttgtgagaaaaaaagtcaaaactatcagggtgggcgaagggcagggggaagctgttgatggaatgaaaaataaccatcatgctttgtttggctcagtcataagcaatatttacttagtcatgaaaatgtaaatactaactatggatttaactaaaaatagagatataattatagtgtggatgtggaagtaggggagatggagctaaaatacctgtccagcaggaaataaacagataatgtctaaaatgggtaagtcaagcaacaaaaatagaggcatatgattttgtgataaaacagtcatgaccagaaggaacagctttaacagggacaagtagttgcttttgcaaaaagagaattaggacgtggctgggtgggaggcaagtaactgtcagctccagggtccacatctggtcctgctttattccacagttcaagtgtattgtgtaaagatcgatattttaattaaagtgtaataaggtgagataattaaatagtaaaaataaataaataaataaaacaaagctgcccattcccttaccttgttgctgagcttcccacagcccccaggccctaccccgagggcttcctgcaggacagtgcacattgcagctgctgcagcaggaacgggatgcactggtcactcacaaaccacaaagcggaactggaagctagtggagtgggggaaatatttgcagtaaatatgacacaaagattaatagctacttatagatttcacatctattaaggttcatctgtaaaatcactgtagttggggtttggaacacagagaaactcacacatgaagcagcactgaatacacgggaaagacacggtcacatgcacagggcacacaggagcgatgcagtgggcacaggtcaccacgcatggcccaggagatgcaaggaagcggagcaccactctgtccactcagatgcccagctctgcactcagcagccacggcgaagagggcagcctcggaagcgatctgacaaaacctaggggtgaatacaggagttcacacctttgacccactctcccactagaaagtaatgacaggaggaatgatgaggctctgggtggcaaatgcataacaggagacaatccaactatctagcaatgaggcattaagtagatcaaggcacatctatttgtggcttatgagttactgggtggatgtggggtggacacagggagcccagtaggccacagcccccatcctccattcccaccacgcctcacagctccctcctcacttgggtggaccttgtacagttctaccatccagcagccatgtaagtatctgccagattaaattccacatccactgaaggatgaagagagcagacaagactttaagcagatttccccctctagcctctctgtgagctccatctgcaggcgctgcctgtagggcctgacatactcagggcccagcacacatggggcctggcacacacacggtctggcacacacaggcccagcacacatggggcccagcacactcagggcctggcacacacacggtctggcacacacaggcccagcacacatggggcccagcacactcagggcctggcacacacacggtctggcacacacaggcccagcacactcagggcatggcacactcagggcctggcacacacagggtccagcacacacagggtccagcacactcagggtctggcacactcagggcacagcacacttagggcatgacacacacagggcacagcacactcggggtctggcacactcagtgcctggcacactgggggcacaacacacacagtgcacggcacacttggggcctggcacacactcaggcccggcacactcaggatctggcacactcaggggctccggggctccagggctccaggatattaatgctggtgcctggagttctcagaggtgtctaggggcacagaagaggcactggctgggcctcctggacagggtgagggtggggcgtcacattctatttcgaaaataaggagtgtttttaaaaagcagtaaaacccataaaaggaaactcctcagagccacatcttgaggtttacctggacatgaacccgtttgcctctttggagtttccaggtgctgggcccaagccctctgtgcaggccccagagcagcggctgggaattcggagggtgtggagggcatcctgaggcagggggatccgggcgggcagcacagggcctgcgggggcgtcgagcttcacagtggacaaatcctgccagcctggcacgtggcctccagcctggggcccgacacctgctggacgatggagggtggaaaaggaaggcccacggtgacatgtggaattttaaacaggttttcctggtttgagggagccgtcacgtctgctcctggcatgggatcactttgctgtggaagcttggatgccggtgcttgcaggccaggcttctgccaggagcccttcaacccacacttcgggctgtggccccgggggctgtagggggtcagccgccggggcctctggttgactcagaggctggtgggggctcctagcagaagctccgagacctccaccttataacccaatgggtcgcagggctgcgcggcagctgtgggctgggctgggctcatacttggtcctacaagtgaagccactttggggaccagcttctgggcccaagtccaaccacaaagaggagatgaaactgatgcatttctaaatgcttcagcttggcagcaatacaaatatttgggaaatctttgacatttaccgagcacctactatggacagagaactcaacaagcactttccaggcgttctcctcaatgatcctgaccgtcgctgcgggctcttgtccttgggaccttaggcagccgccttgctcacccagagcacggaagagttgagatcagaacctgctccccgcccaccctccaagcctcgctctgcactccccatcacagggctggacacggggaacacctgggggcagccagagttgggagggcagagctggaggggtaccctgggctgttaccagccatgagagtccagctcaggaaaaagtggggagcctggccaggtggctctggggccaccatcttgggtgacaactgctcagggctctgggtttcctgccaggagggaagggagatcagccacacacccatatgctgggactctcaaggtgtctatgctttcacagagacctcatgttttgaggacgggtcaaagtgcaaaatcagtgaccaccagctgggagctttgggcatcctgatgggcccactctggggaagagaggggtccaccagtctctgctggcctggtgtcggggtgaggcactgccccgggtgcccccgctgccccacggaatgtctaggccccagcaggtagctgtacccaaagtctcattagtgtccacacctgccaagagtgacacgtgtgcccaccgtgcccggggtggaattccacagagccgctccccagcaggcagctcttcagtcccactggctcttatcagctcctgtttactgcagcgactgcacccgcctcctctctacgatgcgtaagaactgcctttcctgtcaccccgagaggcagggttgtggggcagaagtggtggctccggggctgggcaggcaggcttgagcctcacttgggatcagtcagcttgagccgggctgcactgcagaaacaaatggcctcctgtgtcttgggcttccagcgacagcgtgtgcttctcactcgcgctacaggcacatgatggtcagctggagctctgctccatggcctctcagttctgggacccaggctgaaggatgcctctcatgggaggctctgtgggctggaggatggggacatggtggaaccacatgatagcccctgaggcatctgctcggccaggacattggcgaaagcgtcacccaaacctgacatcaaggggccccggggagaggcaggaaacactctgagcatgaatctagccagtctacccgccgtgtgtccttgagcaagtgaggaccttctccagacctcggtggcctcagccgagatgggcatggccgtggcaggacgactggggtccggtccgtgtgcagcatttccaaggcctggcccctgcctgctgtctctgcggggccctctcattctgctgaggtctcagtgatgattgataagggggacagcacattctgagccctgatgtaccctgcagaggcaagggctgtctgtggtcaccatggtttctggaaccctctgttttccatttgaatcccacacagccagctatggctatggacaaagagtgcaagctctgaatcttctcccagccttgtggccctcagggtcactcaactcccagtgccttacgtggtaggctcctctgagagtgtggacggccacttcactgggctgagctgcttcccccgtgggactgcctgacctcccgacgggcctccggggcgtgtcccgcatgccccactggggaccctccacactggtggcaacgtcaggccagccctgctgggagcgccccggccctggcgttgtgtctcctggctgtccctggtctcctgggcagattttccggctatttttttttcatgcctgcacatctgggttgatttcactggcaacgcgaggctcccgctagacgtctcattttgtttcacagtgggaagaagcatggaataatactgacctcttgatccacgatatatctgggggcaccaaaattcaggagttttctctcctcccccatgtcagaggcagtaacctgtccagcttacctctcagaagcagcaggatgatcctgagctgcttctgtgaatgttcacaagctgcttgaaatgacttcctaccactggatctattgggggagagcaagggggagcgagcctgaagcctccagtgtgcaactcaccccaccgtgtaacacctgactgtgcaactcaccccattgtgtaactcaccccactgtgcaaatcaccccactgtgtcaccccatcattgtgtaactcaccccatggtgcaaatcaccccactgtgtaactcactccactgtgtaactcaccccatcattgtgtaactcaccccatcattgtgcagctcaccccactgtgtagctcaccccattgtgtaactcaccccactgtgcaagtcaccccactgtgtactcacccatcattgtgtaactcaccccatcattgtgaaactcaccgtatcattgtgtaactcacctcactgtgtaactcaccccattatgtaactcaccccattgtgtaattcaccccatcattgtataacttaccccatcattgtataactcaccccatcattgtgtaactcacctcactgtgtaactcacccaattgtgtaactcactccattgtgtaactcactccatcattgtgtaactcactccatcattgtgtaactcaccccattttgtaactcaccccattatgtaagtcactccatcgtgtaactcaccccatcattgtgtaactcaccccactgtctaactcaccccattgtgtaactcacagagcttggtcgtcccatctagtatcactgtcctaaatgcactgtcgggtcactgaacctgcgattagcctgggctttacctacccagaaacacttctgcatgccatgagcacctttgcaggctcagctgtgaagtttctagattccacatgcacttgccccatgagaggccaggatgctgctggagttgtgttcacctcaggtgtgtcatcactgtagctgttccagtccgtgacatagccttgcaatgttggcgtggacgtggaagcgtgcagggaacagtcggcactggcatcaaggccccaggatatggccatccacccccgatggccccaggtcctttcagcccctccgtgtttatttcctagggaaactctggtttggaaccataactgcaaagaggaaagtcacagaagctcagtgggatgatctaacttgcttgccaacaacacactgctctactaaaattctcttgtagtttctacacccaagacatgggccaaaaattcagaagccactgggacagcctgggaagaacaaacccggccagggactttgtcagtcatcccgagtcaaaagcgctcaggggtcccggaccaggagagggggtcttggcccagagctcaccctcctcgctgaggcacagctggggcatgcttggtgcatcggagctaagatgctctgcactgtgcttttaaggagcagggatcctgccagggaggactcttaaacggaaccacaataagcagcgatctacggtcagcccctctacacacagcagatgccgtggggcctgctgagctcaggagcagtgcacctgcactcttgcctcccggtttgacccagctccagcctctgtgctccgtgctgcactcctatcccaccagtaccagcagctgacggcaggggagacgttttttccacgataagaatttgtttgaaccagccatgagttcttccagtaaacacaattagcacataaaactgtgcaccgcgtggtgaaaggaattaggaagatatgctgtgtttactttgtggttccaagagctggtatctttaaacctttgatttgccaagagcccaaatcatgggcaggaaaggagggtaaacccggccccatcacttgcaagcagccgatggataaacagccgcctggcatctcctcacagcgcaactcagctgctgctcccgagctgtgcttccaagtgtggggctgtttgtcctctgcccccgagtggaggctcctgcagagcacagccaggagcagggtggctccgttgatgctgtcattgctgtgcctcagtttccatccacagaagaggggaccgtacagggctcttgagcagaacaaggtcgttgtcatgagactctgggggctgcgccaaatgacgctggtcactgaaaaggaagcagcctgtgttaccaggaccgcatgacctccacaccgctttccagaaggttcgtgaataacccacccctcatttacgtgtaattaggtggaggtataaacagccagccagcaatctgagggggcccctttgccagtggacagccctgctctgtccgtgcagcagcctttggctgtgccctgtcgccctaatcaatgcttcttccactgtctgattctgtgtgaatctctcctgatcaacgcctcctccactgtcagctcacgtgcgaatctctcctgatgaacgcttcctccaccgtcagctcaggcgtgaatctctcctgatcaacgcctcctccactgttggctcacgtgtgaatcactcctgatcaatgcctcctccaccgtcggctcatgtgtgaatctctcctgatcaatgcctcctccactgtcggctcatgtgtgaatcatctcctgatcaatgcctccttcactgttggttcatgtgtgaatcatctcctgatcaatgcttcctccactgttggctcacatgtgaatcactcctgatcaatgtctcctccaccgttggctcatgtgtgaatctctcctgatcaatgcctcctccactgttggctcatgtgtgaatcatctcctgatcaatgcatcctccactgttggctcacgcgtgaatctctcctgatcaatgcctcctccaccgtcggctcacgtgtgaatctctcctgatcaatgcctcctccaccgttggctcacgtgtgaatcatctcccgatcaatgcctcctccaccgtcggctcacgtgtgattcatctcccgatcaatgcctcctccaccgtcggctcacgtgtgattcatctcccgatcaatgcctcctccactgtcggctcacgtgtgaatcatctcccgatcaatgcctcctccactgtcggctcacgtgtgaatcatctcccgatcaatgcctcctccactgtcggctcacgtgtgaatcatctcccgatcaatgcctcctccactgtcggctcacgtgtgaatcactcctgatcaatgcctcctccactgttggctcacgtgtgaatcactcctgatcaatgcctcctccactgttggctcatgtgtgaatcactcctgatcaatgcctcctccactgttggctcatgtgtgaatcactcctgatcaacgcttcctccactgtcggtgtgtgtgtgtgaatctctcctaagtgaagccaagagccctcttggatggaggaggtctgcctgccttgattttgctctgcagaccactcgccttggtttagaaacttcctctcttgaggaaggtgattgcctgctaaagcaaaaattgtcaacactttctggagaaatagaatccagagccactacacataaaatttatatttgggataaaatccaaaattatttgacatatgaagaccaagaaaaatattaccaatcttcaaaagaaatgacaacttttagtttccaatattgagatgaaaagactgttggagttaccagacaagtactttaaaacagctattgtaactgtgcttagtgaagtaaaggtatgcttatgatgaatgaaaatataaaaaaatctaagcaggaaaatataaaatattaaacagaaccaaatggaattttaaaactaaaaaatacaatatttgaaataaaaagttcaggtttaatagaggaaaatagtagtaagcttaaagagattgataaacaccatataaattaaagagaaaaatgatttaaaaagcaaacagatctacgatagttgtcatctcttcaaaatgtctataaagtgtttttgtaagcctcagtaatcataatgcaaaatcctataatagatacactaaaaataaaaagcaatgaattaaaacatactaccagagaaaaccacttaaccacaaaggatgacagtaacaaagaaagagaggaggagaggagttatgagacaaccagaaaacaagcaacacaacggcagtagtaagtccttacttataaataacctcaatgggttggctccacagcaaaattgaagaaacagtggaaagaatcagcgaaacagaagtacaataaaaattacccaatctgaacaacagagagaaaatagactggaaaaaacatgaacagaacctcagggacttctggggctataacaaaagatctgaattcgtgtcatcaaaatctcagaaggagaggagaaagaggatggagctggaaaaaccaaaaataaaatgactgaaaacttaagaaatttggcaaaagacataaacctacaaatatgagaggctgaaaaaactccaaacaggatacattcaaaaaaattcataccaagacacatcatagtcaaacttctggaaagtaaagacacagagagaaatgacattttacccatagggaaaagcaattcaaatggcaacagatttctcatcagaaaccgtggaggctagaaggaagtagcacacaaaactgccaacacaaaagtctgtattcagcaaaaataatcttcaggattgaaagggaaaattgagacattcttaactgaaagaaaactaagaacatttgtcactggcatatccatccaaaaagaatggctaaaggggcttccctacacagaaagaaaatgatcaaagaggaaaacttggaatatcaggaaggaagaacaaggtagcaaaagtatggatatatataatatgccttttttctcctctcaaattttctaaattatatttgatgaagcaaaaattaaaccactgtagctctaaatattaatatatctggaggagatacttatgacaattatatcatagataagagataaaaaagacaaagggaggtgaagtttctatactttactcaaagtggtaaaatgatgatacaagtatacagtgataagctatttatataaatgtaatatctagaccaatcattaaaaactaatataaagagatatacttaaaaacactatagaaaaatcaaaatggagttataaaaattgttcaagtaactcatgggaagacagaaaaggaaaaaagagcactgaaaaacagaacaaacagaaaacaaaaaaaaatgtcagacttaggtcctaaaatatcaataattacattaaatgtaaatggtctaactgcattaattaaagacaaacatttgtagaatggattaaaaactgtgacctaactatgtgttagttacaagaaactcacttcagacataacaatatagaagagttgaaagttaaagaatggaataaagtttatcacgtaaacattaagcaaaaaagaagcagaagtgattatagtacatcagataaaatagacgacagaacaaagaaaattgccagagatagagagggacattgtataatgataaaagggtcaatccaccgaaaagacataggaatgaactctagatatgtatgctcctaatagtgatatacaaagtatgtgaggcaaaaattaatagaacataaaggagaaatagacaagtctacaattatagttggagacttcaacatgcttttctctataattgataaaataactagacagaaaatcagcaagaacatagaacccaataacaccatcaacaaatagaatctaatcaacatttacagaacacccactcaacaacaccagaatatatgctgtttccaaatgccaatggaatgtatactaagatagaccatatcctgggccataaaacgaatctcaacagacttaaaaagaattttaaacagagaatgtgttctctgaccacgatagaatcaagttagaaatcaataacagaaagataacaagatgtccagatgcttgaaaactaagcagtactattctaaagaatccatgggtgacagagaaagtcaaagaaaatcaatgcactaaactgaatgacaataaaaatataaatcaaaatttaagtgatatacctaatgcagtactgacagggaaatttataatactaaatacctatattagcaaagagaaaagtttcaaatcagtaatctaagctcccgcctccagagcctagaaaaagaaaagcaaaataatattttacccaaaatagcagaaggaaagaaataataaggataagaacagaaatccacaaagttgaaaaaagaacaacaaaagagaaaaatcaaggaaacaagtaactttttctttaaaaagatcaataaaatagacaaatctgtagcaagactgaccaaaaagagagaaggcataaattatcaatattagaaatgaacaggggccatactaaagaccctgcagacatcaaaggatattaaaggaatactgcaaacaattctatgtaaatatgactacttagatgaaattgaccaattcattaaaaaaaaaaacccgacaacacatccaatatgaaatagatcatttgaatagttttacaactatttagaaaattgaatttgtaatttaaaaattgccaaaagtgaaatctccaggcccagatggttttattggagaattctaccaaatgtttaaagaatttataattccacccaatctcctttggaaaatagaagaggaaagaacactttccaactcattttacaaaattaatattaataccaaaaccaggtaaagacaataacaaaaaagaaaaccatagaccaatgtcctttattgatataaaaatcctttgttttttgttttttgttttttttgagacggagtctcactctgttgccaggctggagtgcagtggtgtgttctcagctcactgcaacctccacctcccaggttcaagcgattctcctacctcagcctcccaagtagctgggattacaggcacctgccaccacacccagctaatttttgtatttttagtagagatggggtttcaccacgttggccaggctgttctcgaattcctgacctaaagcaatctgcccaaagtgctgggattacaggtgtgagccactgcgcctggctgaaaaaatgaacattgattgatattatacaccaaaattaactcaaaatgaatcatagccctaaatgtaaaaccaaaaactgtagaacttctagaagaaagtctcaaagccagcaaatatttcttagctatgacacaaaagaccataaaccattaaagaaaaacttggtaaatttaaaatttttgctttgggaaagacaccattaagggaacaataaagcaaatcatagaatagagaaaatatttgcaatacatatatctaaacttgtgtctaagataaataactcttatgcatcaatgagaagatggcgaatgacccaacaaaagagtgggcaaatgatttagacagacataaaagatatatgggtgttgaataagcatatcaggaaaatgcaaattaaaaccacaaagagactccagtacaaatccactagaaagggtgaaatgaaaaagactgactgtagctggtattagtgaggatgtggagcaaccagaaaagccagcacatcgcacgattttggaagacagtttgaaagtttccacctatcatatgatgcagccattccccttgtaggtgttgatccaggagaagtggaaagccaaaaactggaaaccacctaaatgttcatcaacagaaggtggataatcagaatgcagtacgtgtaatgcaaaaaattcaaacaaacacacagtgacagcatatcagcggctccaggtgtggggccaaggggccctagctgcagagaatccgcagagtctggagggagggctcggtcgttctgtatcttggttgtggtgggtcattgaattggacactccaaagggtttattatacatgaattatacttcaataaagttgatcttaaaaacttaaaaagaaatttctaatcaaatttttagcaaatcacatctagccacatagtaaaataataatacatgagacctgtctgtgtttatcttaagattgcaagattggttcaatattagaaaatatagccatatttatacatgttatacatttaaaacactaattcatcacatcagaaagggaagtaggtcaaaaagaggaaatcctttggttttcatcattattgctgaaaaggcaatgatataatttagcaaccttacctgaaaaataattactgataaccagaaataaaaggaaacttccttaacaagtttttgctttttaaagtcagtggaaaacgcacttgaatgtgttctacgtgccagcttttattcaccctcctggctgtacatcgaaagccatgaatctccctgctgaagacaggctgcctctccctggaggcttcccatctgtttttgcccaacacatttccacaaccctttagacttagagataaccaagagagaagaaaggtgggggaggaggaggaaagtcttctgcattcctgggccccaccaggccagcagatcctcccggtgggagcagaagtgggggtggggaggctcaaagagcagcacctgcaggggcaggtgccgctgacacccagggagcccgacaggaccctgccctgagcccagctgtcccagaaaccacctggacttcagccaagcgcagtccctgtaaggtatttaatggcatatccaatccacgaagcaccgaaaggctccctggcttcctcctaccgggacttgagaacttcttcagccacagaagcaactcaggctccccaaatctatcaaagaagaccacagggacgtctgcaccatgcacaaattgagaggagcctcctgaccctgaacgtgaaacacccgcaccctcagcccaaaaacagggggcttctccagctcagggctgcagcaggagaccgtctgtagccacaggtcctctagaagctctaccagtgcagcaagagcaatcagcaaataaacaaagtgtgcagtatttgaaagaaagaaaaagaaactatcaccacctgcagatgacacatccaagcgtctctttgtgccaggccctgtatacattttccagccactctgtctcattccacacacattttgcagagaatcgggacctgcccaaggcttacgtcttacagatgctactcctggaatgcaaacgcaggtctggctgattccagagtcagaacttcaagccaaaaaactttcccaaacaccccaaaggatggactcaaagttagtaaaattaagagaggaaattacaatgatggtgagtaaaatcaatatagaaatccaatagcattcccagatgctagcaataaccacctcgcaagcaagagtgagggggagcctgttcgaaataacaacccagcatcttaaatacccaggacttgttaggccaagagatgagtacaaaatttatattgaagaaacaacaaattttgtaaggaactataggaaaaaattgggtcagttgagagatgtcagcatgataccaaaggcagaaaccagagatgggaggaccggtaagtctgagagcataaaaatataaaacccaccatgtacacatttgtaaagcaaacagaaatataaaactccactaagggacatgaaaaagcaggtgactagatgcagaaacatgctgaacacttaggagcccttttatttgttgaaatattttcaaataagtgaaaaaatcaggtaaagcaggaaattgacaatgatacatatacatctcaaatgcttccttttaacttaaaatatatgagtctgaattgatttgattcttgtgagaacatctctgtgaggtctgctctttgaatttgttttttcctggcaaaaagaaaagaaattttaaaaatcttataattcatcactcatggttttacgctttatttccttaaattaaggcaagaattaaagatgctgtcatggtgatctgagggcagaatccctttgaatgtcatcttcctccaatttttacagctttcttgcatatatttggttttgcagcattaaaaacactttgccagtttgtctccaccaagccttcctgagcgctctcccactctgcagtcctggcccattcccaagaggcagagatgcatgcagagggcaccagcgggcctggcagccacccttggctctgctgagccttagctgtgggagaggccacctgggcccccggctctggatgtgtgtggagggatggagggtgcaggctggcctggcatgtcggctatgtgtggccaaccagaagagcttggcaccacccttgacaggaaaactcaatatttgattccctaattcctcccctaggaatttttcctaatggaactcagtgcccacttcatagtagtggttatctctgcataaattttatttccttctttgtgttttcctgtatttttcaaatggtctgcaatctacacggattacttttataattagaaaaaaattaattgtaaaaacattgtttgaagtttaaagagtgccatcttggttactactcaaatctttatactgtccttacgtttttcagtgttaacccaaactgtgacgcccatctccctaggacacatcataggaaggcctgcttcagtgagaatgcactcgagataggaaattacccgtgttgataagcagggcctgcctatgtttttaaatttcaggctccctaataaaaggagtaggataaaatgccagcatgctgacatttcaggacactgccgtccggcgggggactgcgcacagcgctgcccactctgttctgacccccactgtcctctgactcctcctgggttgtcctgccatgttcccatggggaaggtgtcacacccagtgccagtgggtgatgatcagaggggatatgacagggctctaggtggtacctggatggatattttttaaaatagttactaatttattttagtgtgctgtagaaaaaaccaggcagcacaatggaccttcaatctcacacagatgtatttaaatgtatttaaatgtaaacatattttacatttaaatgtatttaatgagtctattgaagatgccctaggtagacaataattcagagcacatggatatggcaaaactttgaaatctgcacacagaagggtgcaatttgggaaactgtcatatgaaatcgcacttgggctgcacattacgaacacggcaggtcgtatctgtgtgttttcattgcttttaaatctcttttagcagctcattctgtgcaggcaccggttctgatttacttaagaagatggtcttaacttccctttgatgggtatcgtcatcctttctcttagttggtttcagtattattgcaataggatatactgaagttttgaataatttattaaacgaatctttacttcctagatacaactatcttgacttttttctaagtactacacttttgaagtaaaataaagcctcacctcaacaacagaagtggggtccagaacatcccgtgggtaggatgtgggagctttcctgcaaggtcgagtggcccctgctgggaccctacctctggcttaaactgtgacggaaagattctgggtattgtggttgcctggagcttccacgattcagcaaggattccaggactgtcctggggagtagctgccgtttaattagcctgacagagagatcgctcctggagaagcctgtagacgcaggactcctgccttgttgaaggatcagatgtagcaagtgaagagggaaggtgaggaggctgccaggcagccggtcagtgggtgccgcttaagagaaagtgttggccaggactgcaggggcaagaaccaggacacaggcctttgatttgttacctgaagggcctgctggggctcggatgcaggttggtgacagactcaaacttgccataaccttttcctcaatgtatcctcattccaaaagtctaggggattaattccaaaatagttagatagcccccttgtatttcttcgtgggtgtttttatgatccttcctctttctttatcaccttaaagcctgacaagcagatgcctggggatggggctggggtgatgaaaccttttagcattgcttgggatgaggcttgctgcctgtgaaatcaatgccaagatgcgctttgagtaaggaaactttctggaattaacctttgagttatttatttccatgttgctgataagggcttgaaagttctgtctgggttgcaaacacggccctgattgcttattaactgcgtgatctcctacaggtcactgattcttctcaagcctcggtttctttatttgtagcttgaggcagtgacacctgcctcatggggtcgctgtgagacagagtgaggcctctctgcccacatgcgctgcagcatccggcacactgtgtgctcagtaggcagagactgtcatccttcttgttacaacaaccaccacagttgtccctggtatttgccagtgtattagtccattctcacactgctaagaaagacctaaacgagactgggtaatttataaagaaaaagaggtttaatggactcacagttccacatggctggggaggcctcacaatcatggtggaaggcaaaggaggagcaaagacacatcttacagggcggcaggtgacagagtgtatgcaggggaactgccctttataaaaccatcggattgtgtgagacttattcactatcacaacaacagcacgggagaaacccgcccctataattcaattacctcccaccaggtccctcccacaacacgtggggattatggaacctacaattcaaggtgagatttgggtggggacacagccaaaccctatcagccagtgagactttgggacccacccttccaggctgcggctccctcactctcatcctcacgcacttctgcggtgcctgagctgcagtcaccgtggtaactgggattgaccttttaaagtatctgttataactacaagcttagtgtcaaaatactattaacctgttttgcctttacagacttatttttaaaatagtgtgaattcagttgtgtttgattagcagcttttcactggagttgccgcccagcgcagcgaggggtcttctgcaggcctcgctgcctctgcactcctgtgcctccaacggagcagccattagttggaccaggctggtcttattctccagcttcctcattatttggggtgagttcctcacagcctcctgttagttctcctgattttgtgtattcttattctcatgttgcccatgtttggcctaagagaaggcgcctcttggccggcttcctggaggactcttgctttcttgcatgccacagcagtgacagctccggcaaggccctcctggtaaagtcattggcagatccctgtctttgaaagtgttcatatttggaagaaaatgagtccaaagctgcgaatgtccgtcctcctgccagagaggcagacagctgagtgctattgtttgggaatctgtaagaactttgctatggcaaaatccctggccaccaacagcagcctcctgaggagagcactgagatagtaaaggtgcctggaggcgatttgcatccatggaccaaaaaatttaattccccccgaactttatcagtggatgtagcaataattggcttcactagcgctgtgtccgttggcaagtggagatcttctctgttcctcaactgtgtagagggggaaacacgcggggaagtcatccacacggcgctggaaacaccaccggacccgcagtgtgcagagccccagggctgtggactcaaggtctctaggaactgtattcaggggagaggagagggtgcggaggacatgacaggtagccatagaaaccagcacacagggtggggccggcgtcccgttggaagtttccattgtaatacacgcatgatgggaaaaaaaatgtaaaagaaatcacctacagtcccatcacccagagaaaccacaaaccatccttgaacattttgccatatttcccttaagaactcttatattgtagttcaaggaaaaaaatggttgggcttatatgtcatatatataattttatatcttttagaacggaattatcacagattactttatcataactcatggatggaatgttattaattcttgataaatgttattctctctttctccatgaccatacattcagagaatttaccacagccacttaacaacctccctattagacatttggttggtgtacatttttcactagtactaataatgctatactacaatgaatatttttggccatagtttttctgcattttgaattatttccgttggataaattcccagaagtagaatgttgggacaacaaatgcctgtaagactcttcataaatatcacctggccagcctgacagcatccaatgctttgagttaaatacaatatattcaataccaaaacatttgtattttgctggagagttctgagaagtttgtttttctcccttgaagacctgtgcaaaccatgttgcatagtgagtagtgcggtgtttaggagcaagacactaggagcactatggtcttccgacacttatggggtacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacattgtggtcttatgatacttatggggcacctactgtgtgcacccaacacactgggtgctgggagggatgaagaagaagaggctgaatcctcagggcatgccttctcctcctggcctagagtgagggtgacgcctggatgggcatcgtggaaaagcccctggggagattctgagcaggactggtggacacagacgtggacaaggtgtcccagagcatcctggtcatgatgcaggagaagctcgaacgcacgctcagccctggtcgtgacagaagaacagagaggaataagaaacgcctttaggagctcccaacccaagggagtgggaggatgttctgcaccgtttttctggaagcttgggtctaatttttcagttacttagttacttatggctttgaggctggatagcttcgtatattttgtttcctgaaatgaccccacaggttctacagagcaggagaaaaggctggacaggggtccccactggatgagacgaccttcccgccccctcggtctgggagtctgtgatcttcagggccagcccccagctggcaggccccacctggaagctgagtatgcctctgctggcggtcccagccttggcaaggcagctcttatttctctccagcctgcggtggttttgataaagcggcatttctgccttgttggagcctggttagtgatgatgcatcttagtccaggcctctcgagtttgaaataagaaccccaacccttggatgagccagaactgccttggtttgctggtgtcagttcagagcattgaaattcctgcttcactttaaagaaaaatctgtgcagtaagaatctgtgtttctagactgcgtgagagaactcggaactttctgtcacttatttttagagatgtcccaacaatgattccctctgccaagcctctgcctgggggaacccaccttcctgtctcaggtgagcctgacccctccccacccctttgctgctgctggacttcagaacagattgcaggcagcagctacaaacctcagcttctgaaatgtcactcattcatccactcgcctgtgcaatcctctctctaaactccctattggggccagttctgcaagtgtgtctagggccgcacacacaacggtgggcaaggcccgcactcactggcacgatgggtctggccctccaggacagacagtgggcctgtcaccgggcccgtgacttccagacacgaaccctcctctttagcgaagcagggaatttgtcaaatactggccctagcaggcatagcacagcacctggcttctaacaatcagtgaggggagaaaaggtgcaggacactaatggggccacatttcttcacgaggacttcaaggttctgcacaaggaggtgagtgaatctcagacacaaaaagtacattctgcacggtttcgtgtcagtgactttcaaaaacagaccccacttacctctgatgggagacaccaggacggtggttgctctggtcaggagaccccacttacctctgatgggagacaccaggacggtggttgctctggtcgggagaccacacttacctctgatggcagacaccaggacggtggctgctctggtcgggagaccacacttacctctgatgggagacaccaggacggtggttgctctggtcaggagaccacacttacctctgatgggagacaccaggacggtggttgctctggtcaggagaccacacttacctctgatgggagacaccaggacggtggttgctctggtcgggagaccacacttacctctgatgggagacaccaggacggtggttgctctggtcgggagaccacacttacctctgatgggagacaccaggacggtggctgctctggtcgggagaccacacttacctctgatgggagacaccaggacggtggttgctctggtcgggagaccacacttacctctgatggcagacaccaggacggtggctgctctggtcgggagaccacacttacctctgatggcagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatggcagacaccaggacggtggctgctctggtcgggagaccacacttacctctgatggcagacaccaggacggtggctgctctggtcgggagaccacacttacctctgatgggagacaccaggacggcggttgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggtggctgctctggtcgggagaccacacttacctctgatgggagacaccaggacggtggctgctctggtcgggagaccacacttacctctgatgggagacaccaggacggtggctgctctggtcgggagaccacacttacctctgatggcagacaccaggacggtggctgctctggtcgggagaccacacttacctctgatggcagacaccaggacggtggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagaccacacttacctctgatgggagacaccaggacggcggctgctctggtcgggagtggggggcaggtggtgggggttgcgagaagggtgtgcaggagcgttccgacgagaggctgtgtctctattggggtgagggttgcataggagaagcaactgatcaaaactgcacaatgaagatttgtatatttcattatttgcctgttttacctcccaaatccctcattcaggtgcgatggaatgggagcactggagacacagacagctgaacgtcgcacgctgttgcccaaggctggtccggctgctggggctgcacgccaggccggggtcttgggttctccgagtttatgcctcttttccggcctgcgaataaaccaatagagaagaggaggtcaggaacttggtgactgtgccatccaacgtggtgagatgaaggcaacagtgcccatcttagaaggttgtcgtgaggattatgtgagttaatttacaaagagcacacaacatgcccagggctgtggttgttttgtgaacatcattaaagtctggtaaactgttttcccctcagctgtggctgcagcactggaaacactggctgcctaaggtgctggaggtcggactgcagtctgggtcctcccagtccagattcctcagcttcactggacagacaggctcacctttggaaacgccacaaaaatccacttgtgctatttgtgttggtttattactaaatggacatgtgatttatttggcatagcaactctgccttttcccaagaggttccctgcttggggtattatctcagatggagggctgaggctgtctggtcccatcctggtgagtggtgggcgaagagacgtggtgtccaaaccacatcacaagtactggaagggggtgttaaaatctctgtccacattggaaattaataaaacatattattccccacagataggttgcaaagccctggtctacaaggtcagggacctttttctgtgggcccagcactgtccacagcctgagagcagagagaacagagaacaggtgaagcagctgtgactaatgaacctgccctgccttctcctctagggcaatggagataggcccagggtgtcctttggctttagccaagctctaccatgcagacagtaagacaagagcagagctgcaacaaccaccaggcccatgatatgcccccagccaccccacagagaatccactattaataccatgttactcgccctatcaatcccacattaccccatcatcaatcctactagctatagaccactaagctcaagggtctgtcgccacctcttgccacagtcagtgtccatgaacagtgtctgcagggctgctctctcagggctctgaagagaagccaatggtggaaacctggatgttggcagacatggctcatggcagtgggcatctccccatttcaacctcacatatttttcacatggttcaggaaccacagagcattccagccgttcatagacacggacatgatgtcagtatttcctgctgaccttcctctgtggaatgtgagggctcctgccccgtgggccccagttgggagcagcactcctggtccatctgccaagccaactgcttttcctccttctcacctctctgcaaagcatactttcgccaccacaaaaggggagcataaaaggaaggaatgtaccagccacatgccaactcttactctccctctttgcagcataaaccttccgatttcttataaccctttcccatctaaagccaattggtgcatctcaaatagcaatatatgattctgaaattaacaatagaaccttattagtgcaaaatgaagcccagtttgctgtaggctgagatgttttgaaccatctaagggagttgagttattttagcagcacaaagacattctccaaaaacatgttctcctggaaggcagcactagacaaagagactaatgatatcttgtgctgttgggtaatctcaggtgggcccttaacttttccaaatcacggtctctcaggaggctgcagatgagtgggttcccacggcctcttttgagctctggcactagacaaggtggtttataatgggaaggggcaaaaagtgagctgtggagtctatagacttagtttgaattctggtgtttcaagtttccaggggtgtgacctcaaagagcatgtttaacttattctcagataccctatctgtgaagagggtatggcaacttaagggttaatacagaggattcaaaataaaatatttaaatgataaatttttcaataaatgatattaggacaattagttatccattttgctaaaacaaaattcctcctctctactctttatcgcatgtattaaaacacacttcagaggatcaaagatttaaatgtaggctgggcacaatggcccatacctgtaatcccagaactttgggagactgaggcaggaggattgcttgaggccaggagtttgagaccagcttgggcaacctggtgagtctctacaaaaaaaagaaataaaaaattgggggctgtagagaaaaaaaattaaaaaattaaaaatttcactgggcatggtggtgcatgcctgtagtccaagctactcaggaggctgaagtgagaagattacttgagcccaagaatttgagccaggggtgagctatgattgtaccactgcactccagcttgagtgacacagcaagacctggtcacacacacacacacacatacacaaattaaaattaaatttaataagttttttttaaaaaagatttaaatgtgaaagaagaaagagggcactccctctgtggtcgccactggctctcagaagtagtgcgtgagcaggaggctccactctgatccaggagcactggcatctatgaagagggaaaccaagaaaaaattctttctgctatctttcctttcagtaatgcttatcttaagaacactcaactggaaaaccactccacctaaaagtaggaaagatggcaattctaaatagcaactattatcccagggagacccctcagatatgtgaggaatcaagccataaatgtgcatttgctggacattatataccacgtcatctctatgactacagattttaaggataatttttactcacttaacaatttcactgtaacagtgactgataatgtgaaaatgtgctttatacagtgctgctgatgggtacacagacaagttcttgctgcaattatttctaaatctagccagatcccagagtcatgaagatataagctctgtgagaccagggaccatctctctttcttgcatcataggcacacttgataaatactcatggctggaaaaaaaaaaaaagagggaaagatagagaaaaggagggcaggacaaagaaaaggaaaagaaagacagaaagtaatagaaagcaaaggtgcatatttttataatcttagaatgaagaagaccactcaggaaaatcttaacacctctctggataaaaaattcagaaggcactgcaaaaaacaaagctaataaaatatgtttacacttttaaactctttgtgggaaaaaaacatggtaaataaaagaaaaactgggggctgggagttttcaattcacttacaaagagttgatttccataactacaaagcatgcttaccaattaaaaagtagagaacaggacccaacttttggtaatggcagaatagcccccactgaaccaacctttccacaggtaacagctataaactttaggtaaaatatggggggaaaacctgcttaaaagcactggagtgtgatagaagcaggcaaacactggagttcttgtggtgatggaaatgtcctgtgcttcaactgcactaatgtttgtgtcctgattgtgatgttgctctgtagctttgtgagttgacattgggggaggctgggtgaagaggacacaggatttctgtgttacttctgtgtgtgaatctacatatacttcaaagtaaagtgtaatttttaaaaagtcaatttatggctaggcatggtggctcacgcctgtaatcccagcactttgggaggctgaggctggtggatcacaaggtcaggagatcaagaccatcctggctaacatggcgaaaccccgtctctactaaaaatacaaaaaattagccaggtgtggtgacaggcacctgtagtcccagctgcttgggaggctgaggcaggagaatggcgtgaacccgggaggcggagcttgcagtgagctgagatcactctactgcactccagcctgggcaacagagccagactccatctcaaaaaaaaaaaaaaaaaaaaaaaagtcaatttatgtaatttatatgattagaaaataaaggattaattctaatcatcaacagatgtataacaaacatttgaaaatcaacaaccattaatgattaaagaaaaaacccaggaagcttgaaatagaaggaaattatctcatactgataaagaacattcttaaaaacctagagtgaacataaatatcagtttcctcttaagataggaaacaaggcaagattgaccattctaaccatttctttccaccattgtcctagagggcatggttggtgcaatatgacaagaaagaaagccagataaacaaaaacctcacagcaaaggctgaaggtctgtttacctcagcttcttcggtctaacacatcatgtccagatttccagaaaaaattacaaggcgtgccaaaaggcaaaaaatactgtcagaagacacaaaatgagcatcagaaccagctcagatatggtagaaatttaggaattatcagatcgggaatttaaaatacctatgattaatgtgctaagggctttaataatagaaaaagtgaacaatattaaaaaatgaataggtaaaattgaaatgcaaagaaagtgtaaaaaggaaatgcaagaaattataaacactgtaacagaagtgaagagtgtgtttaatgggttcatcagtgagctgataagaaaagaatcagcccgatatgtgggtcaaagaaacctcaagagaaattaaaaagtattttgaactaaatgaaaatgaaaatgcaacctatcaaaatttgtgagaatcagtgaaaacagagcttagagggaaatttacagcattggatgaatatattggaaaagaataaacatctaaagtaaataacttaaaattccatcttaagaaactagaaaaagaagagcaaatcaaatgtaaagtaagcagaaaaaaataataaaaatcagagcagaaatcaatgaaattgaaaacagaaaaacaataaagaaaatcaatgaaatcaaaatttggttctttaaaaacattaataaaattgataaacctttagtcagactagtcaagaaaaaaaaaagagaagacacaaacctctaacatcagaaatgatagagggacatcactatagatcccgtggacattaaaaggataatacatgaatataatgaacaactctatgcccagaaatttgatacctagatgaaactgactagttacttgaaagacacaatctaccaaaactcacaacaaggagaaatagattatcttaatagacatatttcttatagaaattggatcgataactgataatcttcccaaagacaaaacaccaagaccagaaaggcttactggtgaattctaccaaacatttaaggaagaaattataccagttttctactatctgctccagaaaacagaaacagagagaatacttcctaattcattttataaggccagcattattctaatatcaaaatcaaagacagtacaagaaagggaaactaaggaccaatatctctcatgaacatagatgcaacagttctcaacaaaatattagcaaattaaattcaacaatgtataaaaagaattctgcaccatgatcaaatgggctttattccacttacgcaaggctggttcaacatccaaaattagtagtgaaattaatcacatcaacaggctaaagaagaaaagtcatatgatcatatcagtagatggataaaaaacatttgacaaaaatccaacacccattcatgatacagactttcaaaaaactaggaatagagaactccctcaatttgacaaagaatatctacaaaaacctacagttaatgtcatacttaatggtgagaaactagacacttttcccccaagattaggaaagggcagagatgtttcttttcacttgctcctattcaacatcatattaaaatgcaataagacaagaaaagtaaataaaatgtatgcagattagaagacataaaattttctttgtttgcagatgacatgattgttcagatagaaaatgcccaagaatcaacaattttaaaactcctccttaaactaataagtgactataagaagattgcagaatccaaggactataaataaaatatcaattgctttccaatatatgagcaatgaacaactgaaatttaaaattaaaaaaaaaaaccatttacattagccccaagttaaaaaaagaaaaatatgtaggtgcaatctaacaaaatatgtatacgatctatataaggaaaactacaaaactttaatgaaataaatttttaaaatccaagaaaatggagaactattccatgttcatggataggaagactcagtattgtcaagatgccagttcttcccaacttgctatagagtcaatatattccattcaaaattccagcaagttattttgtgaataccaggaaactgattttaaagtttatgtagaaaggcaaacgacccagaatagccaacacaatactgaagaaaaacaaagtcacagaactgatactacctgacttcaagacttactatacagctatggtaatcaagactatgtggtgctgttgaaataatagacaaatggatcattggagcagaacagaaagtccagaaaaagacccacacaaatatagccaactgatgtttgaaaagaaacgaagacaattcaaatgagaaatgatagtcttttcaacaaatggtgctggaacaactggatatccacatgcaaagtttaaaaagtgaaattagatactgattctacacttttcactaaaaatttattcaaaatggatcatagacctaaacgtaaaatgtaaaactataaaacccctagaagataacataggagaaaatctagatgaccttgggtatggcaataactttttagatacaacaccaaaggcatgatcctgttgatgacaaaactaaactctgcgaaatattttaaaaggattattctgagccaatgtgagtgaccatggcctggggaacagtcttaagaggtcctgagaaagtgtgtctgaggtggtcaggttatggtttggttttatatgttttagagagacagaaattataagcaaaggcataaatcaatactcagaaggtatatattgattgatcccagaaaggtgagacattgtgaagcaggggcttataggtcataagtgaattcaaagattttctgtttggcagttggttgaaagagttaagctttgtctgaagacttgaagtcagtagaaagaaatgcttgagttaagataagaggggttgtggaagccaaggttcttgttatgtagatgaagcctccagatagcaggcttcagagagaatggatggtaaaagtccctttttggaccttgaaagttgtcagagtttcaattaatctctcctagatctggggaagtcctggctgtattaatggagattctctacagatgcgaatttcccctacaaaaggtggctttgcagggccatttacaaatatgtcaaagaaatataccatgggataaaatattttcattttcttcagggtttgctatctgtcatgtgatgctatgccagagtcggttggaatttggtatcttactgccacagagtcttctctgtcagtttcatgatctctattttaatgtaaatgttagttagctgtgcctaaaccccaacagggaggggttataatgaggtgtgtctgacctctcttcccatcatggcctggaatttagtttttcaggtttctctgggatcctattggccaagaggggtctgttcagtcagttggggggcttaggattttatttttggtttacaatccataaaagaaagaattgataagctggactccatcaaaattaaaaactgctctgttaaagacattgttgagagaatgaaaggacaagccacagactagaagcaaatatttacaaaacacatacctgataaaggaatggaacttaaaatgtacaaaagactcttaaaatttgacaataggaaaaaaacaacccagttaaaaagtgggccaaagatctgaacagacacctcaccaaagaaaatatacagatggcaattacgcccatgaaaagatgctgcacatcgtatgtcatttgagaattacaaattaaaacagcaatgaggccaggcccatggctcactcttgtaatcccagtgctaaaggaggccaaggcaggagattgcttgaggcaatgaactcaagaccagccttggcaacatagtgagacaccatctaccaaaaaatttaaaaattagctgggcatggtggcacacacctgtggtcctggctactcaggaggctgaggtgggaggattgcttgagcccaggagattgggtctgtggtcagccatgatcatgccaccacactccaacctgaatgacacagcaaactccatctcaaacaaacacaaacaaacaaacaccacaatgagctactactacacacccattagaatggctaaagtataaaatatgaacaccaaatgctaggaaagattaggagcaacagaaactcttgttcattgctggtgggagtgcaaaatgttgcaactgctttggaaaacatttggcagtttcttataaaactaagcaacctttaccacatatatataatgaaaacaaaccaaactttcttctcctgctatactgtcaacacagaacacttctggtcctcaaaatgtggaggggctttctccacacacctgtaattgcctgacgggttcttcctgcctgccatacagacaaaatctattcatgagaccatggcattgtagtagagaaaagagtttgattgatgtgaggccggcccacacgggagagctggagctatcccttaaatcagtctctccaaaggcttagaggttagggtttttatggacaattaggtggacagggggttatggaattgggtgctgctaagtggttggggacgaaatcacaggagcgtggaaaacagtcctcatgtgctgagtcagcctctgggtggggccacaggaccagcctagtcatgagacaggagtccaggtggggtcaatctaaaaacatctcaaaaaccaatcttaggttctacagtaatgatgttatctatagcagtggtctccaaactttttggcaccagagacaggttttgaggaagacaatttttccacagaccagagggtgtgggggaaggtgttgggatgaaactattccacctcagatcatcaggcattggattctcataaggagctcacaaccctagatccctctcatgtgcagttcacaatagggtttgcactcctatgagaatctaatgacaccgctgatctgacaggaggcagggctcaggcggtaatgcttgctcgcctgcctctcacctcctgctgtgcctcctggtttttaacaggccatggagtagtacctgttggggaccccaatctatagaagcaattggtaaagacacaagtcttgtgacctctgctcacatgactcctgagcagtaaggggttatagaaagcatgcctacatctcagcagatttcagttcctcccataatcctattcttgtagctttcaatagtcttacaaaggcggttttcagtccttgagcaaggaaggagttagttttagggagggactattattatccttgctttcaagtggaactataattcctcctgaagttagcttggcctacacccagaaatgaccaaagagagcttggaggtcagaagcaagatggagtcaacaatgttagatttctcttactgtcacaattttgcaacagtggtttcacaccaagcaattctccagtgcacaccaacagtgccccataattcaatttaattctgacactaactaaagttagcacagatgctgcaggttgaggtatttgcctcacaagatggcccttatttccaatgccaattgcaagtcccaggtcatttcaccagtgcttccaaccttctggctattaatgcggggttctcatggccctccttgtgttagattacttgctagaatggctcacagaactcagggaaacactttacttatgttcactcacgcatgataaaaggatgtaaatgaatagccatttggaagagatgcaccgggagaggcgcgtgggaaggggtgcagggcttccacactctctgtgggcaccactccagggacctccatgtactcaccaaccagaagctctctgaactctgtccttttgggattttatggaggctatcatgtaggcatgatttgttaaatcactgtccactggtgatcaacttgaccttcagccttctcccctccctagaggttggggatgggaccacaagttccaaccctctatgcacatggctggttcctctggtgacctgctccatcctgaggctgtccaggcgtccccagcccccagtcatctcattagcacacaaaagatgttgtcactccacagattccaaggctttaggagctgtatgtctgggaaatgggaaaaggaccaaatgtacatcacaagatcatgccatacaacccagaaattatgctccaagagattacccaaatgagttcaaaaccacacaaaaatgtgcacacaaatgtttatagcagctttattcataattgccaaacttggaagcaaccagatgacctttcatgggtgaatggataaggaaactggttcacccagacaatggaatactagccagtgacaaaacaaaatgcgctgccaagcccagaaaagacatgaaggaactgtagctgtgtttgctaagtaaaaggagccaatctgaaatggttgcacactgtgattccaaccatatgatattttgggaaaagcaaaactatggagacagtaagagaggagtggttgccaggggtgagggaggagggaggggtgaattgggagcacagatgagtttaaagcactgaggcggctgcaatgctagagtggtggacacagccgtgacatatccatccaacacacagagtgggtgtagtgcagaccatggagtttgggtgacagtaatgtctcagtgtagcttcacctattgtaacaaatgggtcacactcatgcaagctgtcatttgtttattattattgttttagagacagggtctcactctgtcacccaggctggagtgcagtggtgtgatcttagctcactgcagcctcgacctcctgggctcaagcaatcaacctcccaagtagctgggagtacaggcatgcaccacgccagctaatttttttttttttttgtagagatggggtctcactttgttgcccaggctggtctcaaactgctggcctccagtcatcctcccacctcagcctcccaaagtgttgggattataggtgtgagccaccaagcccagcctgcaagctcttagggaaaactgtggtggtggggagggaacacatggggacactgtacttactgctcaatttttctgttaccaaactaaaggaagaaactgaggcaaaactaatgtgatttatttgcactgagctgaggatgactttccccaacgtatgcccagcttgccttggggagtgccccctgggccctttgttgcaagcaggttttcaaaggcaaaaagggggttcagggactggcctgacaccaagttgttcatcaggaattcttaccaggagcaagtgtgtcagtgacaggacggtggccaggcccgcctttcccctcgtgatggtcatcgtccttgaaataccaggaggcagcaggaccccccagggtccaggttcagtctttggagatgcagtccgagggtctgtctgcagagcctccattcatgcagaccaacatggaacaggactcacgggggcacacgtctccgccttgccatcaaccagatacatgtgtgaattcccacctggccctgagtcacacccagtttagtgctttcacgggaggaacacctgccgtcctcacagcagggatctccaaggatggcccaaatatcggcttcccagtgatactgctcgttcctgcttggaaactccttttccacggtggtgagatattgaacttgactcatggaatagaagctccccgggatgccaccaccttgtgaaatagcagctcctcaaattaccttgttatgcttctaatgccagggtccaaagaagccctctgttgccaccagatacattttgaacccagttcatttagaaaccatggttggtggtcatcatctacttgtgttctgagaaaccacaaagttcaacttcagctcttcagttatggtcttttcatattattttagaatgtgaaatttatgctgtgtgtccctccttttatgtcatgaacacagcctgctccgtatggtgcctaacgctcctgtgacccctgggctttcctcgtgtttaacgttctggttttctccttccttgaggtccctgtggcctcttcaaggtcctgccttcctcccatttattctttgtggttctgtacagactgatgcatttattttgcctttcccaactaagtattcctcactctgttcttgatggaggggagaaggagggcaaagaagttaaatttacttcagggcatcaaaatgaatgtctacttaataactttgtaaaatgtaaagtgatacatataattgtaaagtagtgttaattttacctaataattacagttaaaaaatatatcattggtttacagaagtaacactgcttagtgatgagctacacattgttgagctgtgggcatgggttatggagtccagcatgcagcattgtgggcttcatttgcgctgttccaagggatgaacccacagctcaagggggagtgggaagtggctgcggtcttgttttttttttttttttttttttgaaacggagtcttgttctgttgcccagtctggagtgcagtggcacgatctcagctcactgcaaccttcacctcctgggttcaagcagttctcctgcctcaccctcccaagggactacaggtgcctgccactatgcccggctaatttttgtatttttagtagagacggggtttcaccatattagtcaggctggtcttcaactcctgaccttgtgatctgcccgccttggcctcccaaagtgctgggattacaggcatgagccactgtgtgcagccagtggtctcgttttaatgtctcccagggcctgatatttttaaagggctcaaattcctcagataagaaaagcatattgaagcaaagactgcttctgagtaagaacaacagaagcaaccccagcacctggaatattggggttctaaaaagcgacttcttacatgaacttttagattttattattttattgtctatggttggtagcatttaatgattcacctgaacgtgactttgaaacatacgctatggcacaaaaacgaattccaattccaattaatgatgggaagagaatgtgtggcctgggaagacctggagtctgctttggagttatgtcctcacctctaaccctcatggcatacatttgtgtaacttttgcaagcttggaagaacacgcatgcctgatatccacaccccacccgctggaacctgtggattgcttgcttacaccgcaccagggactctgcatagggaactcggtgatgaatcttgagatgggagatgctcctgatgacctggtggggcccaggtaacctgcagggtcctcctaaggacggaaaggcttgaggcagagactggacactgctgtgctgtggctgtgaggatgggttaaggggcaggaaccaagggagacagagatggaccccccagtgcctcccgacagagcctagagggcaacgctgccatttcagaactgtaaaacgacagatttgtgttgttttaagtcaataataacaacaacaacaaagtcaggctaattctttctttcattcaataaacactgaatatggaccatgtgcccacgatgctgggagtgaggacacggctgtggaggacattgccgggcacctgcacttgggcaatgcagctcacagctgcaccgagactcacagagcctcctgctgaaacagcagaggccttcgcgggcaggggccaggggcgggtgggtggagagagcagcaggcgctggccgggccctgggatggccgggtagcagggagcaggcagaccctccctaagaaacccagcaccccgctgtcctcccggctgccggcgcccccgcgcgctggccccccgcccaccatcgggcgccctgctggtcaccgggcctctgcggccgcctcagcgcatgagggttccgtgaagaggggtcgcgtgcccctcagccggcattcccggggctcgggaccccggacctcccagaggaatcactctcctatgccagagcctggcctcaagggagacgctggcgtgaatctaccccggcccgccttggaggggatggggctccgagcctggtctgggctgtccaactgggcataagcgtcacagccactgccaggggagggagaacctggccagaggccccgccgtgggctgtggagccagcccctccgcagccctgtccatgtggggcaggcctggtggcccacacagccggtgctggagcctcgcgaggagggggtcgggggacaaccgcatctgtcccagttcccgtgagggcaagacggggcgctgtccaggaagaaaccctgtggagggaggggagcgcacctcaacgtttcttccttccactcttgcaggaaaatctgggggaaacgttattaaggcagaaagagtgaccctgttcctttttttggtaactccattcactccacttcaaccataagaatcccaagcaggaaacttaccaagcatcacaaaccacctcgaaaagcaacaccacacaacctacatgctggaccgctgaggggacatacacccggccactgagcggacgcacgcagggcccctgagtgacgtggggacgcacgcgggggcgctgagggacgtggggttgctgagggatgcacgcagggccgctgaggggcgtacgcgggactcgagtgacgtgagcacgcacgtaggacctgttagtgacgtggggacgcacgacggggcactgaggggacgcacgcggggacgctgggggacgtgggggcgccgagggacttggagggcgccgagggacgtgggggcgctgagggacgttgggggtgctgaggggacgcccgcaggggccgctgagggacgtgggagtgttgaggtaacgcaggcgggggacgctgaggggactcatgcggcgggtgctgaaggacgtggggcgctgaggggatgcatgcgcggggcagtgagggacatggggacgctgaggcagcgcacgcgggccaccatcggccaaggatgagaccattagaacatctgcaatgggttgaaacgcctcgaatgcagtaagatccaggagttataacgatactaaaaatagcaacaatgacccaagtcacctttggacatgctaaaaaccagcggtacctcaggatgaccaaatagttgatgagaaaaaatccctcttcagaaaagtattacagctcacaggtgaagaaaggagacacagaatcggagcatcttccctccgaagccccacaatggaatcaccggtgcagggagatggccaggcctgcggcacccgagagaggccgtctgacccgggtcctctgtgcaggcagagccccctccggtgttgtgttcccgccaaaactggccgcgaatcgcagatgatgatgccgggatccgcgcccttgcaggagagacgggggtgtggggaggatgccggcagctcagggcacagtccagacctggggacaccacgggacaaaagacaagtcacgagaggaagaagcggagagaaccaaggattttttcctggttggaaaaaacagagtcttaaaaatcctgtgggatgccagggagtcctgggcgctgatatctggtggcattaaggagtcaccatcaattattttaggcataaatacagaactggggttgggtggggtgtttggttcttatctttgagaatactttctgaagtgtttatggataaaataatatgatgtctggaactgttttaaaatagcccagtgaggaagcgggtggggtgctggccttggcaggaacacggggccattgtgctggtctctcgcgttgtgttggaactcactataaacagcaccagcgagggacggcagcctgccctgtgcctgccctgaggtcactctcactgtgaactcggctccctccagcccagctctcacagggtcacaggtggtggcttcagccaatgtcctgtgcaggcttcttcctgaaggaacacagagtcctgagagtgggatttcctgtggtgattcttcggtctcagagtcccgagggacacgcgtgtttgagaatcttctccatgtccatctggatgatcttcgccttcattctcctctcctattaaatggaggccatcagcacacttagacacgcctgccagctttaagagtttagagctaaacaaatgaagcacacagtgcacttcaaagacttcgagaggaaggctcagtgtgcacagaggccccaggaaccctgagcttccccaggatgcccatcctgagccctcgggggccatctaacccactcaaactccaaacactagtctctcccccatcacaaggaaagacaggcatggtcccccacccatcagcggtgttgctgaatctggcagccactgtgtttgtcagacctgcctgccttgttcagcagggaaaccacttgctatgatgaatggagctgcatgtgaaacttagataagcaggcaggtcgaaaacacctcctgtgccagcattccagttttcttgcttggcccaagaacctggtttcattttggaaggtggagggagtgtgtggcgaccttgttgccattttcaggcatggctgggctctcacacagtcactcttagaacagacatgtccctgcctggaggccaggccctcttgggttgtgggaaccaagcccaaaaatgtcaaacaagtggcaaaacctttagggtaattttcctctaactcaaaaaacacctggccgcttctcctccccagatgttaaaggtccttttattagcattgtcctattgtgtttttttcatttctcagacacagacacaggaagcatcaactctgaggctttggccaggatgtgagcccgactttcgcagccccaactggcaggctgacctcatgtgaactccctggcgatggcatcctggagacacccacatggctgagctggcaccatagggtgagggcaccagggccatggggaccgtggttgcttgcctcagacatggccagcaagggaggcacaacatggggctgttgagtgaatgtgtgagaggctgtgggtccccacagtccagccaccagcggcctcgcagcatcataggagtctgaggtccaagacaccggactcacatctcaaccctgccctgtgctgctcagggccaagtctaagctgctgtgacaaagaggcccccacatgcagcagctgccacagaacacggtcatctgtttttcatgcacgctgtagccctggtcattccagccagagcctccaggttttgttgctcttccagggcacgttctgggctgtgtgatggaggctggactgtgggctcctctgaggaggtagagggatgcgcaccagggcccccgtgttgaggctcggctcccaccccatcacctctactctagtgaggccacttcctgcgaaggtagctggatgctcctgcctggagctgcccccggaccacagagcatccaggagatgaatgcacttccagccccgccaccctggggagatatacagctgaggtggcagctttggagcaagcagggcagagatgcttccccctgaggtccctcccagctctgctaccttgtcactcaaggtatgggttggttgtgttccccaaaaatacatgttaaaatctgagtcttcagcacctcagaatatgacatcatttggaaataaggtcattgcagatctaattaccatagtgaccccttatcctggggaaaatgttccaaggccctggtggatgtctgaaacctcagatagtacctaaccctatatacactgtgttttttcccatgtgtacagaaatacgataaagtttaatttataaatgaggcacaataatagattaataacaatgataaaatagaacagttataacaatatactgtaataaaagttatgtgaatgtggtctctcgctctcaacatatcttactatactgtattttcccttcttcttgtgatgatgtaaagtgctgtaaaatgccacgtggtgagatgaagggaggtgagagatgcaggcattgtgatgtagatggaaaattccagaaatagaaaattcctcagtgttcagttatattctgttccgagccatcccatccaagcctgggttgccattggccacttggcagtcatcctagtgaccagatgggctgtggtgtcacagtgcttgtgttcaggtcacccttcttttacttaataatgcccccaaagcacaagtgtagccatgtaatatttgtggagcgtggttgaccgtgagtgactaaaacccagaaaagtgagatggaagacaacgaggaccactgtagttaggatgaagtcgtgactgtgtccttataagaagaagggtgacacaggagcccatgtggtggtggaggcagagatggaagctgtgaatccacaaacccgggagcatctggagcttcggaggctgaggaggcagggaggaccctcccagctgttgggggagcacagccttgctggcaccttgattttggacttcaggcctccagagctgagagaagatacatttctgtggttttgagctccccggtttgtggtacttttccaactgccccaggacactgctgcgccaatgcccttgaccttcaaggttgcattctggctgatggagctgatgggcaccccggcttcactgcccttgggctcccactctgactggcctgtgctgaaaggttaaaaatagctctgcatatattaaaatagctatgtcaattctaaaggctcacacagctgctctaagtgtcttggatactcttcaaaataatatttataggcctcttcaggctctgtcgaaccagcttttttaacattaattaaagccaagctcattagtttgtttacaagttggacttggcacactttagcacttaacaggagatgaaaactgcagtttgttcaattttcttttaataattttgtttacatttttgccagcactcataatccaggttcagtttctgccagcactaatttggtttattccacatggctggagccactgcgggactccatttgttccggggccaccttcctgtcaccttttactgtttcttgagtcagcaagaaaggcagatccgactgaagactccagcactctcctcagctgcagcccccacagagctccgcgaagtcctttctcccacaggacagatctgaggcacccaccattagaagaaaggagtggagaaatgatatgcaggaagaaggcccattctgattcaccaatcgcatggacgcactttcctaccaggctaggagggaggaaagtagagccccaccctgactgctaagccgtttgctttggtgtcatgaaaaaagagttcagcttcccaaatcagagaggaaaaggttttcaaggggtcccctatttctattatgtaagctttaaatgacaaagtggacctctggggccaacgtgggtgtgtgatggtggttttgtgggattctccccatagccccatcagacggcctcaccttctgggtctcagtggccccaggtgcaacacggctcctccagaaatgatgacagccctggcgaccaaggactccctgtgccactgggtttgcgctcagaagtatattcaatgatttccccagaaaattccaagtcatctcctaatactgtttgtgaaaactaaatgaactgtcgtggtcttcttcagggacagtttgctaggaagggtggttattggcataattttccaaatcaatgaactaagttacaaaactttctcaaagaccctgatggctgttacaaagacagaaaagtgaatggtcagaaagaagtgtgataattcacccagtattgggaggacgaggtgggcggatcacgaggtcaggacatcgagaccatcctggctaacacagtgaaaccccgtctctactaaaaaaatacaaaaaattagccgggcgtggtggtgggcgcctgtagtcccagcttctcgggaggctgaggcaggagaatggcgtgaaacctgggaggtggagcttgcagtgagccaagatcacgccactgcactccagcctgggcgacggagcaagactccgtctcataaaaacagcctaagacaaccacacagcacacaggccttcatccttggctgtgacggatgcgtgtccgtgtggagggccaggcctgtttctcccgtcactaatggaagcctctctgagtttccatgaaagtctccccctcagaaggggctctctggaaattttcaattatgttggttaggatagtaatacatgcttttgcttaaaaatcaatgggtgcagaaacaaaagtataaagtacaaagtgggtttcccctcctcagccagaggcaatgatgttagcaggtcaaccccgataccgccgctcattgcttgaggagcctgtgtctttccttatgtacgggggtcatgccacggccacccctccacacgagagcgggggcattgactaaggccagagccaggcactggaaaggcgcagtggcccctctacctcacaatggtattgctaggacccacgtgcatttggggccccacatcaaagctccccaagcaacccccttgaaatgactttgcttatagctcacctccaggaagggcccttccctagagaacagaaggacacaatatccctcaggctctgggaaagcagccgttatcctggaaaccaggactcctaggagattctgtgcctcccccatgtgggccgtcttgatccccacacagactccaggttcaggtgctcctcgaggctgggcatccctccaccaggtggtcctggtacggcccctctgtcctccgctctgggtcttgtctgatgagctcatgcccgttcaccacaggctcctgggaggaggacggtgaggcgggcagccctcctgagccccttcctccttgcagagcactttccggggcctgatgcagtggaaggagctgagcagttccccatccagcccaaaacaggacacctcagggctcgaaaccctcagagtccccacccacacgctacccacacaaggccgatgcctgagtgtgaaacacagaacacctcctccatctccacctgacttcactgacttccctgagcattaaaaaataaaaactaaaaataaatgaaaccctgaagggtttcaaagcaggagagaggccatgtccagactgaaggaggcacattcttgatgagtccctggtccagcaaaactcccacctcagatcagcccaatgcttttgtgtcgaatgccacacatgtcatggtgtctgtttgtttgactggttttgcccagtctggaaggcttggagtcacaaagttaaggtcatgaggcatgactgtgacaattaaggctgtccccatgacaggatgtgaatctggacttcagggtacgggtccgtccctctgagagtgaagggaaacgtcctgcccacaccacaatggcacctacatgacacctagtgacacccacacggcagtgacactgacactgcagcgacaccgatgtggcaacgacacccacatctcagtgatacccacgctgcagtgacacccacacagcagcaacacccacatggtagtgacacccatgcagcagtgacacccacaccacagtgacacccacaccacagggacacccacaccacagtgacacccacacctcagtgacacccacgcagcagcgacacccacaccacggtgacacccacaccacagggacacccacgcctcagtgacacccacgcctcagtgacacccacgcagcagcgacacccacaccacagggacacccacaccacagggacacccacaccacagggacacccacatggtagtgacacccatgcagcagtgacacccacaccacagtgacacccacatcacagggacacccacaccacagcgacacccacacctcagcgacacccacacctcagtgacacccccaccacagggacacccacacctcagcgacacccacacctcagcgacacccacaccacagcgacacccacacctcagcgacacccacacctcagcgacacccacacagcagcgacacccacacctcagcgacacccacaccacggcgacacccacacctcagtgacacccacgcctcagtgacacccatgcagcagcgacacccacaccacagggacacccacaccacaaggacacccacaccacagggacatccatgctgcagcaacacccacacctcagtgatacccacaccacagtgacacccacaccccttttcttctgcagccctgaagtcactcccaggccccaggctgaggactggcctcagggcgtcatcagaagctgcagaggcatgacagtactgtttcctcagcagcttcatggaaagatccagccaagccatctggggctgagctttgctgcgtcttcctgctcctggccagtgtacgggcttcctgtccttgaaagcaacacctcacttccgacgtcccaagagctgaacttctaggtgtcaggaaccaagtgcctcaaggctctgggcactctagatttcaggtggagctggctggtttcccaccccaaggagagggcacacggttgcttgggtgttgctgtggccctggctcccggtgtcctgctggaggagccttgctcgggtgcccctgatgcagccctggcagcggcagcagggccagccacatggccacctcccatctctgtgaaagggaggcctcactggaccagaattttgccagaccttccagttgcttccgaccaaccagcaggtcctgcagcgtgatgcacatttgctgttctgggtgacaacccccaatcccatgaccgggtcagacaggagggaccgtgcttctctggagagcgagctcagaccatgttacagacacagagaagtagaaaatgtgatgaagcggctaattatgttgctcaaatagacgtggaaatcccgcatcgtggtgcccctcggggcaggcggctctgttaccctcgctcagctacccacaggtgatgctagctgggcccagtgtggcctttgcctccccctgagcttggcaaccccgggctgcctcctgggacggggctgtctctcccttggggatcaggcagctgttgctggtctcagacgacacctgcttgggcccagccccactgtgagggtggcaagtggagctggaattcccacccaggcggctgacgccacagtccagagcccatgcctcatctccgtggcctgcgctgctccattcttgtctaaaatggggagtgagataaatgccccacttacctccccttcccaggaaactctctctgctaggcttcctgggtaaagcggggcctcaggttcccacacggcccggtgtgggtgctgccccaggaaagaactcctttaccgaaaactaccagacagaccctcaccccgaccccctcccgcccatcaccatcaacacacacactctcgacctccttgctctcgacaggcaaggccgtgagcggtgaggagctgtgtgatgggaaacagggaacctccaggccaatgcactccatccacctggagggcttatcatacacctggagggcccctcacacctgcagggcccgtcacacacctggagggcccaccactcacctggagggcccctcacacacctgcaaggcccatcacacacctggagggcccctcacacacctggagggcccctcacacctgcagggcccgtcacacacctggagggcccaccactcacctggagggcctgtcacatacctggagggcccgtcacacacctgcagggcccatcacacacctgcagggcccgtcacacaactggagggcccctcacacacctgcaaggcccatcacacacccggaggatccgtcagatgcctggaggtgagccaatgactgcccgctcatggcctggagagagctctgacatcactcagaggagaagccaggcagagcccgatgacccctcgagtgggggcagagccaggtgaccaggaggctgaggcagcagggcacggggaggggcatgagagaagagagaggctcacggaaaaaggactttggagatttgcagaagatcctctctagtttccagctaaatcaccacacccttgagaagaaacgacccaaggccagagaaagaaccatctgggccgggtgcagtggctcatgcctgtaatcctagcactttgggaggccgaggcgggtggattgcctgagctcaggagttcgagaccagcctgggcaacacagtgaaaccccgtctctactaaaatacaaaaagttagccaggcatggcggcatgtgcctgtaatcccagctactcaggaggccgaggcagaagaattcctagaacccgggaggcagaggttgcagtgagtcgagatcgggccactgcactccagcctgggtgacagagcaagagtctctaaaaaaaaaaagaaccacctgaaaggagtagagggaccaatcccgcagctctcacaggtccggaatagttcccgtttccatccctcagcgtggaaaatctcattatccacaggacattagggtgagcgctcacaaaggctttgcctggagtggcagcttttgccctgactccctgcggctctggttttgccctaacaatgcctaaaagcaagactttagagataaaaaataaattgtctgagatgaaggatatactggatagaattaacagcagatatgacattgcaaaagaatagggaacttgaaggcatagtaatagaagctaactgaaatcaaacccacgcagagggggaaagactaaacaatgaaaacagaatagccttagtgagctctgggaaaactccaagcagccatctgtatgtatacctggagttccctaaataaggagagcatcttggggacagaaaacaatatttgaggaaataataccccaaaattttccaaatataaaaattagaaacccacaaatccaagaatctcaatgaaccccaagcacaagaaacctgagagaaactacagggtacaatgtgataaagtttcttgaaattagtgataaagagaaaatcttaaaagcagccagaggaaaaagacattatgtacagatgaacaaagaaaagaatgattgccgatttcctgttggagacaatatatgctaaaatacgggagggcaatgtctttgaaattaaaaggcacaggggaaactgtccatctagaattctatttgcagtaaaaaagatccttcaaaaaaatgacttttaaagacatacaaaaactgaaagaatgtgtcaccaacatacatacgctcaagaacattttaaaggtttttactgaggcagacaaaaaaaaaaaaaaaagataccagattgagtctgcatctactcaaagaaatagcagtgctggaaatgataaagatatgagtaaatatttttttctcatcatttaaatattttaaaagcattgtttaaagcaaacaatagtactctgtattgcaaggtttatgacacatatagaagtaaaatgcaagaaaacaacaacataaagagaggagagaaatagaagcagactgctgcaagtgaacaggtgactctaataagttaaagctgtataataaaaatcacacagcaacaccaaaataacacaacaaacaattgcagttaataagccaacaagggagaaaattctatcataaaaaatttggttaatccaaaagaaggcaaaaaataaaataaaataaaggaaaggaaacaacaaatgggagtaatagaaaacaaataacaaggtagtaggtttagaccaaatcattttaataagtatattgaatgaaaatgatctaataacccaattaaaaggtaaatatcagattggatttaaaaaaggaagactcagttacatgctacctacaggaaacctaccttaaacattaagacaaaaatagaataaaggaaaaagaattttaaaaattatatatatatatatatataatgcaaacactaatcaaaagaaagctggcatggttattttaacaatcagacaaatagatttcagagcaaagaatattatatctcattatgataaagggatcaattactcaggagtacgtaatttaaatatttatgcaccaagtaaaaaagtttcaaaatacatgaagcaaaacttgaattgtaaggagaaatagacaaatccaaattctagttggagagttcagcactccattcttaataactgatagaataagaaggcagaaaatgagcaaggatatggtagacttgaacaagactatcatccaacttgacctggttgacatttatagagcattccatccaataggagctgaataaacattcttttttagaacacacaggacgtttaccaagatgtaccatcttctggccacaaaacaagtttcaataaattaaaaagaattcaagtcatatacagtatgttctctttctacaataaagccaaattatacattgataaccacaaagatatctagaaacttcccaaattgttggaaactaaataacacagttctaaataatccatgggtcaatgaagatatcaaaaggaaaattataaagtattctgaactgaatggaaatgactcacttaagtgtgggatttaaaatgtgtaggatacagctaaagcacggctttaaggaaaatttctagcataaacatctacattagaaaagaaggaagatctcgaataaatgacctcagctttctacttaagaaactgaataaagaagagcaaatgaaacacactttatttcatttttatttcatttttcttctgtgggcagaagaaagaacattataaaaattgtataatgagaaaataaaaaatgacaaataatacagaaaatagagaaaaatcgataaacccaaaagctagttatttgagatcaataaacttgttgaatctccagccagaatgaccatgacaaaaaattaaataaaaagacaaattgtcactatcaagagaggtgtcattaatacagatctacagagattcaaagagtattgaggggctagccgaggtggctcatgcctataatcccagcactttgggaggccaagacgggtgaatcacttgaggtcaggagttcgagaccagcctggctaacatggtgaaacctcgtctctactaaaaatacaaaaattagccagctatagtggcacacacctgtagtcccagctactcaggaggctgaggcgggagaattgcttgaagctgggaggcagagattgcagtgagccaagatcactccactgcactccagcctgggtgacagagcgagactctgtctcaaacaacaacaacaaagagtgttgagaaactattatgagcagctttatgttagcacagtaaacaacttggatacaatgggaaaacttccccaaaaaaacaaactaccaaagccaataaaaaagaaatagactatctattaaagtatatatagaaacagagtcttactctgtcgcccaggctggagtgcagtggcacaatctcagctcactgcaacctccacctccagggttcaagcaattatcctgcctcagcctcccaagtagctgggattacaggtgcccgccaccatgcctggctaatttttttgtatttttagtagagacagggtttcaccatgttggccaggctggtttcaaactcctgacctcaagtgatccacccaactcggcctcccaaagtgctaggattacaggcgtgagccaccgtacccagccttaaagaatatatattaaagaaattacatttataggtaaaaacctccccacaaagaaaactataggtcctgatggcatcattgtgatttttgccaatcatctaaggaagaaataagaccaattctacacaaacacttccataaaattaaagcggaagaaacacttaacaattctatgaggccaacatttcttagatatcaaaccagacaaagaaagaaaacaacagatcagtaccctcataaacatcaatgtaaatattcttaacatgtttttgcaaattgaattcatcaataatttaaaactatgatatatcatgaccaagtggggttaggattatttcagggacacaagattgatttaacattcaaaaatcaatcaagataattcacatattaatgaataaaaaaacccatatgatcatctcaatagaatagatgcagaagaaaactttgataatatttaatacacattcctaatttttaaaacataatttgcaggaagctagaaatagaagagaacttcctcaacctgataaagagaatctatgaaaagcctacagctaacattatatttaatggtgaaagactggattattttcacataggatcaggaacaacacaagggtacacactgtctccatttctagtcaacattgcatgggaggttattaggcagtgcaatcagacagaaaagaattaaatagcacccagatttgaaaggaggaagtaaaagtgtctatatttacaaacagcatgattatctatgtaagaaaaattctactgaagctacaaaaaaatcagaataattgaattaagcaaagttgtgtgatacaagataaatacacaaaaatcaaatgtttaaacaattagagattgaaatgaaaaacaatgccaaaggccagatgtagtggctcacacttgtcatcccagcagtttgggaagctaaggggggtgggttgcttgaggccaggaattcaagaccagcctgaacaacacggcaaaagcccatctctacaaaaaatacaaaaaattagccaggcatggtggcgcatgcctgtagtcccagctacgtggcaggatcacttgagtctggggggcagaggttgcagtgggctgagattgcgtcactgcactgcagcctcagtgacagagtgagatcttgtctcaataaataaataaataaataatgccatttacaataggacaaagaaagtgaaatatttagaaacaaatctaataacatatatatcaggcctgtacattgaatactatgaaagactgtggagataatttaagaagacttaaataaatgaaagatataccgcgttcacatatcagaagcctcaatactgtcaaactgttcattgcctaaaaattgacctatagatttaatgcaatctcaattaaaatcttggcaggctttttgtaaagaatgaccagctgattctaatattcatatgtagatgcaaagaaaacagaataaccaaacaactgcacactttgagaaagaagaacgtttgagtatttacactacctgagtatttacattacctgacttcaattcttgttatgaatctactatagtcaagacagtgtggtattaactttaaaaagagacaaacaaataaatgggacagaacagagtctacaaatagatttgcacatatattatcaattggttattgacaaaggtgcaaaggcaagtcagtggagaaagaatagtctttttaacagtgctgggatgattgcatttccctaggcacatacgtacagatacacactttgtttcatacttcagcatttataaaaactcattcaaaatggatcaccatcttaaatgtaaaactgaaatctacagaacttctgtaataaaatctttgtgaccttgagttaggcaaatgtgacaccaaaagcagaatccattaaagaaaataagctgcacttcaaaattaagaattctgatctttgaaagacactttaatttctttttatcttggagacagagtcttgctctattgtgcagaccaggcttaaactcctgggctcaagaaatcctcctgcctcagcctctcaagtagctgaagctacaggcacccactaccatgcctggctaaagacacatttaatagaatgaaaagacaagccgcagactggaaataaatatttgcaaaccacacatctgataatggacttgcttctagaatagttatagaactcttaaaactcaacaaacagctcaacaattggaaaaccaaacatcccaagtgtattagtcaattttcacgctgccgataaagacatacctgagactgggcagtttacaaaggaaagaggtttaactggactcacagttccacgtggctggggaagcctcacaatcatggcagaaggtaaggaggagcaagtcacgtcttacacagatggcagaaagcaaagacagagagcttgtgcaggggaattcctctttttaaaaccatcagatcttgtaagacttattcactatcatgacaacagcatgggaaagacttgcccccatgattcaattacctctcaccaggtccttcccataacatgtgggaagtcaagatgagatttcggtggggacacagccaaaccatatcaccaagtaaaggaaaagaaagaaagtaaaactgaaacagacatttcaccaaagaagatatctggatggcaataagtacaataaaatttgttcaacatcactagttatttgaaaaatgcaaatttaaactacaatgaaataccattatatacatattagagtgagtaaaattttttttttcagtggagtgtagggtttctttttttatttttatttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctggatacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccccaaaaccgccattgtcatcatggcccgttctcaatgagctgttgggtacacctcccagacggggtggtggtcgggcagagggcctcctcacttcccagtaggggcggccgggcagaggtgcccctcacctcccggacggggcggctggccgggcggggggctgacccccccacctccctcccggacggggcggctaaaaatttttaaagtgaccacagaaagtatgggtggggatgtggagcaactgggaccctcatgcattgatggtgaaaatgaaaaacagtataaccactttgaaaaacagtttaaaaagttaaacaaatacctactatgggatccagacactctgctcctagatatttccccaagagaaatggaagcacgtgtgcacacaatgtccacacgatggacacacacatgaatgcctacagcagctttatttgtgatagtaaaaatttagaagcaagtataatgtccctcaacaggtgaatgataaacaaattgtgttatatccatacagtggaatactactgagcaataaaaaggaatacacctgcaacaagatagatgattctgaaaataaatatgttaagtgaaaaaaacagacaaaaaagtgtacatacagtataattctttttatataaaagtctagaaaatacaaacaaatctatagtgatagaaagttggtcagcggtttttgcatagaaactgggatgtggggtagggtggggacatttaggagggaggaattaccaaagggcatgagaacacttttttgggtgatggatatgttccctaacttgattgtgatgatggcttcacaggtgtacacagctttccacctcatggccacagaccggttaaccatccatataaaacatccattgccctgggtccaacctcctgccccctgtggaggtgaactgtctacttcaccattgatatttcaggttgtatgatatagtgcctgacaactctccatttttggaacacatccaaattgtttcttattcattttccatttctgccttcgaacgaatttcctgcactggtaactaggtgaagaattttggagttatctggggtaatggagacatcctccattgcaccgcatatttgctttctgtattccccagttatagaaatcaaaacgagcagttgtatgtgaatgcattgtatcaaaccaagtctctagatgataggaggcattgtcattactaggatagtaactcagtagaaagagtgaattgagaatatgaggaatgagagtggggtccagactaaaaggaggccaggggtcctgaactgccccatccaactgagttcattctgatacctactgatctgaagcagcaggtccacgcccaggtgcagattgtcccagatgaacaggcagaggctagagatgctcattcctaaagggatcaaataattctgagaatggcaagaactccattaactctcttctccaaaactacaaaaatgtgcagaaaatacgaacaatttttaggagcttacactctttgaagtttatccatgggctgctggaacccttaggaaataatagctagaagtgcctcagacactgcctggcacacagcaggtgctcaatgaattacactgcctggcacatagtaggtgctcaatgaattgtctgatgaagtgattaaggagccttgtaaatactgattaaaacatgtatcaccccatccaatttttcaaaccagtgcttctcaagaacaagcaggaaaattaatgtaatattgttttgaagtagccgtggtggtttcggggcagaagcccaggggtactccttactccgcctgctccagtaactagctgacatggaagtgcctcgtcattctggttcagacacaggtgcagatagatgacttctctatcccactttaattctccttgaagatcattcccagggacattcatttgcttaaattaacatgctcggccaggcgcggtggctcacacctgtaatcccagcactttgggaggcccaggcgggcggatcacgaggtcaggagattgagatcatcctggctaacacggtgaaaccccgtctctactaaaaataaaaaaaatcagccgggcgtggtggcgggcgcctgtggtcccagctactcgggaggctgaggcaggagaatggcgtgaacccgggaggcggagcttgcagtgagcagagatcacgccactgcaccccagcctgggcaacatagcgagactccgtctgaaaacaaacaaacaacaacaacaaaaattcatgctcataatcccactttcaaaccagtgacctcaaagatttctagcagcaatcctattccattcttccaattacagaaagcaaagagaaactggatctggggatctaagcgttgagcctgctgagcagaacggccattcatttggggtgaggtgctgactcactgcccctctacattgcattttggggtgtggggatttccagagcaggattctccagagaggagtatccaagctccctcctcccgcagcagggggatgctgggctaactgcctggttcggtcccccgtgagtggtctgctgtgttttggttctgtttgtttgtgtgtgttttgcctatgactttgcgaaatattccaagacaagagccagaaagtcttggtctctgaagacaagcacaatgttgctttcagcttaaatatctactgggaaacctcaagatttttaatgtcatcattatgaaaaacagagattataaaaggaaaccgtcgcatttcactcgctggcccccagtgggattggatctgacctcagtgtatcttttctttggtaggttttaagtcttgacaaaatgtgcctaagaatgaagactccaaaaaggatgcagtagattcggggggagtgggggttggaaagaggcttaaatcttcacatgacacctggaatatggtcaaaatgtacctgctcaagttgaaccaggtattgcgtcctccttttaccccatcgctagtgaagacaaccaccgcctggggagacgctccttttccgaaacactcgagtcccgccgcgtcccggacgctccgctttccccgcgcccggatcctcccgggaacccgcgccccgcccgcgcgctggtcccgcccccgccgcctccccgcgcgcagccgcccgaacacgcccagaccgagcgcttgaggtgccgcagccgccgccgccgccgccgccgcgatgtgaccttcagggccgccaggacgggatgaccggagcctccgccccgcggcgcccgcggctcgcctcggcctcccgggcgctctgaccgcgcgtccccggcccgccatggccccttcgctctcgcccgggcccgccgccctgcgccgcgcgccgcagctgctgctgctgctgctggccgcggagtgcgcgcttggtgagtcccgcgggcccgagaccccgtccccgggcggcgggaggaggctccgggcgcggcttgacgcgtccccctctctccctccgggcagccgcgctgttgccggcgcgcgaggccacgcagttcctgcggcccaggcagcgccgcgcctttcaggtcttcgaggaggccaagcagggccacctggagagggagtgcgtggaggagctgtgcagccgcgaggaggcgcgggaggtgttcgagaacgaccccgagacggtgagcagccggcgggcgggatgcgggggaacccctggcgcccgcgcgcctccaaccgctcccgagaggcagcgctgctgccgccccccagctccgcgcggcgaggcctggcctcagggtcccaggagccccggcccgccccgcgtcccccacgcccatcccccggcgaccccgggatccccgcgcaggccggtgagacgctgcggggctgtccgggaaacgctcgctgtcagacgcctccccgcggggaagccgggagtccgtttccaaagtgcgagagaaacacaatggttaaaacccaaaccgcttccccgcggccctccctctgctgggctggaggtgaggaacccccgggccgcgcctcgtcctcctgagaggggtggagagcagtcccctcccgaaagaggaattgaaagggccgagggcgggaactgcttgcggcagcaggtccaaaaataagattccaggaatcgagcggggccgcatgcgggaggggagggcggctccgcggccccgttctgccaggtgctctcctggaggcagcgggtgctttcaggagcccgacggtgctggccccggcacctcggttaggaatgtccttggagaaggcggggcgcccggggccgcctcccgcaggagccgccgtgtgaggacggcctggccactctatcctgcgggctcgggagcgggtgactttggaaagtccgagaaggtgtggattcccgttgacgtccctcccgccctgaagtcagggtgatttcatagcgaagttttccgttctgctggaatgttccttttaaagaattctcctggggtggaataaatgtcacccgggatgaaagagtggttctggatgaaccatggaggcctgtttccgcttacatttctagtggttgacttgacccctcttagatctgcctttctgaaagctctgaggctgtcagatggccactgtgcacttgtggacatagctcatccctgcagagatgacgcacctggggctgttgcccgggggctgcccacagccccacaggcccgtgccctccttcagctcagcctagcttggtcgctctccccggcctctctgttttcctgtttctttaatgatgaatcctggcctgtgctgctggctgaggcaggtgggcctgtgtgccctggtcgctcggagtcgccgcccagctgtggggttggtcgtgtggctggtgcagtgtcctccaacagcgtcctcacccggaacattctgcgtgcacagggactgtggcatggggcgtgctggtgatgggagttgagggcagcagggtcacccccaccccacagtacccgctccgcgcagccctgcaaggcctggccgcagcccctcctcgctgtcctccaggacctgcagggcccatgtcaatcagactggacgctgcctggatgtactgtgctgttcttcccaagtcagtcccctacctggttttccaattttaatttaataactttatttacaaaggtgtgaaatgaagataagaaaatgaaaacagcactcaggaccccatcactttaatacaactgcggttgcgtcacatggtttctgtgctggcatgttcatctcctcaccctcctgcatgtggctgagtggctttggtgcccgggaggcatccctcccatcctctcacagcctggccccagcagcctctgtcggcttcttttcagcgtcatctcagttcccagcgttctgccctccttcccagcccccatgccaaatgataacaacccgctttccctctggtttttggatctggccattagcttgctgtctgtttctgtttctgtttccggttcctgccggcaggtggatgctggggacagcctggttggggcaggggcaggggcagggtccagaggctggcttgagtcccagccggctccagcacaccaggcccacccctcccaggaccctagtctccactgcatcctctgccacactcttgggagaccccaggcccgaggggactgtccaagcacaacttcctgctaatgcatgaaaatcatccatgaacttctccctgtcaaaggccaggggctccttgtctttgaaatgttgctcactttacattttgtgcagtgcggctgattgaggaaaagggctgtggcctgagctcaagaggtgaccaggacctggccatggtgactgtcagagcatccttgggtccctggcctccccaggcccaggatcctgatgtgtggtcctccacgggtggttgtagggaaggtggtcccagccccctgccattttaggatgtgggaagtgcctggccgccgttagttaacacgcacctacccagccctggctgtttcccctgggcaggctcctacgagggagggaagggacagctggagccagctctccagtgtgctcaccttcatgtccacctgctaaactgctaacctgcccgaagtgtgtcccactgccccttgctggggcatcttcctggttgcgccttcttcccggaagcacccgctgtgcagcccttccagcaggcagatactaagcccggcacccctcccaggctccaggctcacttgtgtgctaacctctgtgcccacctggccacctgctcacctgcctgaagcgtgtcccactgccccaagctggggctgcttcctggttgtgagggaagtgcctgctctgcagacccccaccttccagcaggcggatactaagcccagcacccctcccaggctctggccctccccacacacctgtggtttcaagccctgttctgctggaagggacactcctcccacctccccagccctctctgctggagccgtgcccctcccccgacattcctccaggctgggccacccccacatgcctccttgctctccaccgcccagaccttctccttatcttgttttcctttttatattgttgttctccctccctggccttgcctctccctgctgggttccttgcccgagtttctaattcagagaagactgggtaactccccacagtgtctctgctaaagcttcccaggcccagtgactttttactaaatcctcgaaggccatcaggttccagggcctgctgaggtctccataatcaccccttgattccagaaatgatccgagactagagacttatcccagcccagccctactgcccaggtcctccggtgcctgcctgggagcctgtttgtgcactttgatccccggcctgcctgccggaaaatcatccaggctgtggttcctgatcccatcacctggctttatctgagatacaaagcacaatattcaccgagggctggtggccttccctgagggttggcctggattagcaacctgcacctgtacccgcacctgcacgacatgtggccaggcctgtgctccgaggccaggtttcccttcccccatctctttctttgtctccctctgtgtttctctctctgtcccagtctctctcttctccccactgctggtggtgaggaattctccgcatgggatgttggtgcatccgttttcaaacttgctggctcatcctgaactgcatgtgccctccaagcaccttttccctgaccttgtggattctttgggaacagctggggaaggggtaccctttatggaaatgaaaacccctctgagtccccacttgggaacagccacttggctgggacacaggcccagatgttgggatggcctaaagggaggtccctgttggaggggagggctgtacaatgtgggggcgcctggtggggaaggtgatggccaggctgagacctcccctgccctgccttgacagaggctgcagcacactcccacacacagacacatgcacacacattcacacatggacaccagcacagataggtgctgactcatggatacaggtgtgcagggacacacacacccctacctagacacatgcacacatgtacatatgttcccatagacacagatatacatgcacacacacaggcacacacatactaacagacatgtacatacgtatgcacacattcacatagatatacgtacacacacacactgacagacatgcacacacataaacaggcacacacacatactaacagacatgtacacatacatgcacacattcacatagacatacgtacacacagtcacacactgtccagacatgcacatacaaggcacacacatactaacagacatgtatacatacatgcacacattcacatagacatacagtcacacagacatgtacacatgcataatgacatgcacacacatactaacagacatgtacacatacatgcacacattcacatagatgtacctacacagtcacacagacatgcatacataggcacacacagacatgtacacatacgtacacagtcacacacacagacatgcacacacaaaggcacatactagcagacatgtacacatacatgcacacattcacatagacatatgtaagcacacagccacacactgacagacatgcacacacatacatgcacacattcacatagacatacgtacacacagtcacacactgtccagacatgcacatacaaggcacacatactaacagacatgtatacatacatgcacacattcatatagacatacagtcacacagacatgtacacacatgcatgacacgcacacacatactaacagacatgtacacatacatgcacacattcacatagacttacatagtcatgtacacacatgcataatgacacacatactaacagacatgtacacatacatgcacacattcacatagacatacatacagtcacagacatgtacacacatgcataatgacacgcacacacatactaacagacatgtacacatacatgcacacattcacatagatgtacatacacagtcacacacacagacatgcatacataggcacacacagacatgtacacatacagtcacaaacacacagacatgcatacataggcacacacagacatgtacacatacgtacacagtcacacacagacatgcacacacaaaggcacatactagcagacgtacacagacatgcacacattcacatagatgtacatagtcacacacagacatgcatacataggcacacagacatgcacacacaaaggcacatactagcagacatgtacacatgcacacattcacatagacatatgtaaacacacagtcacacacactgacagacatgcacacacatgcacacattcacatagacatacgtacacagtcatacactgacagacatgtacacacatgcataatatgcacacatgtacacacagtcacataaatagacacatatacacacacaggcacacatggatgcccagccacatgcatgcagacacacacagacacatgtgcaccctctcacacacttttctctttctacaactttggggtcagaagaccactgacagctgcagcaggatcactaaaaagtgacacaaggtcacggggctctgtggccccagcttcctcagacccccagggtctctccactcccagagccccctgcctgaggggccggagccctgtggccaaggcctttcctcctgggcccatcctgaggcctgcaggtggaccccggcccggcctcctctgagggccgtcttccgtgctggctccgcagccctctcctgtgcccgcacctgtgcagatgcttgttttcacccgggcgtctgcaggcacttggtgccaggctcctccggggctttctcagaggcagccgagtgccaggccctgcacacgacaccctcacccgagccggagagcttcacatctgtggaaaactctaattaaagacgttttgagaaacgctgaacgtctccctttgttatttaggaacaaaacactcttttaggaagcaagtgcttatggcttctttcttgagattctgagtaaaggggcgttaagcttgctagctggggcatgctgagcacttcccaggttatggctttaccccagagcgattgacaggcatccaggtttcctcatgcttcattttcccctgttttctaaggttaaaactgagagctgtttctccaatgcaaagctgcttgtttaagggtttcgtatttgatgttggaaatgctctggactcttccatggtttttatattccagtgatttcactgcaaacctggtgtgtacgccttgtaaattttgaccctggccaagtgaaaggttcattttaaaagttttaaaataaattttaaaggggagctggaagtggaataagttaagaacagtatcagttttgcctttcactctgacagaggcactctctgctctgactgacgggtgttgattaaaagtataatattcaaaagaaatagtaaagtgcattgggccttgttaatgttctactaattttctggggctccgttttcaaattataggtgaaatttttttccttccagtgttagtgcctatgataagaaaatacattttctccacatctgtccacaaacctgctagaccctgttttgtgactacctccccttggaacttggggctccatggaaaacacacagcttgacccagccagccctcagagagcctgggccggtcactgcagtggctggattctcagcataaaaaggccaaacgttcggccaggctgggactggctcccatccaggaccaactgtccacagtacagtaaggccactctctgagtcaacattgtttcttttctgaattgctaagttgaccgtccctgcagaagcagagagggctgcggtgtggcattcctgcccactccaaatgagggcagcccggacgcgggagctctcagggaggcgcagtgggctttgggtgtgtctggactgtctccaccacacctggaagatactgttcacttcctttttacacttgtgggaaatacatgacagtgtttacgggcaggctggctttccgtttatttcaaccctgacaattgaatagcagcagcagatgatgaaactgttcacttcccgatcactcccgttctcagatccatcacttagctcgtccgtcgctcagctcgtctgttagtctgaaagatgaatcgtgcacgggtcctcctgagagtgctgttctcggggtctccatgtgtgaagttgttacatcctcatgacaactgtgtaacagctgtcactgagccattttacagatgtggaaactgaggccctgagaggctgtggagggctacagtgtgtcctgggcatttgagccccacactctgtcattaactcctgtgctcgctgggactgggggagagcaggacgcggcagcacccccggccccactgtgtgctcctctgtgtgcaggcgactgtgagcatactggcacccatgtgagggctgagtggtgctggtgtgggcgcataaagcacagggcggctgcggggagctgggtgtgtgtcagtggctcggagcattagtctcgtgaacatggtctgccaggtgcgtcatgctgggctacagagcccatggctccaccataaatggtggttttgtgtttgaacttgagtgttgctgctcagtgaggccagaggaaggcaccaacctgcaggcctggccggtcctcacaacacggaaggcaaccagtccactagagagacatgtgtcccggccactggaggagtccaagtgacctttaagtctcaccagtcctcagagcaacccaggtgaatttggggcctgagcttggtcgtctggccgaagaccagctcaacttggataaagctggaggagaagcctgtccctcaggcagctgccagggcatctgtgatttctgcttgcgtgcactcttggcgactattggtggtggtcgcagtcagggcatctggttgcctttactgtccttacaccagctgggcagagctcaggctgggagcccagtgggagaggccggggcgtgactcccggcgcagaagcggcagtggcacaccggcgtcccaagcacagctgtccctgccaggcccctgcgcgttggatctttgggttgagtcatgctcgatggtgcagccatcctttcaagggaactgagctgtccagcgtcccatggagcagctccccgtggatccggagaggccgtaaataaacctccccatttgtaagccgggaacacacatgaactttgcaatcgtgtttgtcctgggatcatagaacgtggtggctggcaagacccaggcatcctcatcctgtgctgctgtgaacagaggccggtagcttattgagggaccagtcccagttcgctttctgtggggaagactctgatggaagcctaggccccaaactccaaggttagcacatcttcttggggggattgacacctccaaaggtgaacttgggtccaaggcacgtgtgtgcgacctgaagcatgggtgccgtgtgcaggagacgccctcaccggagatggggaccgagtccacacggctctaactgcagaatcactggccctgtgcccacgactattttattttgctgttttatatgatcacaaagtacactgtcttgtttttcccaaagcatttgcagtgagacatcccacttcctctccacggcagctgttgcgggcacgaggctgctcccaggacagcgatgccaccggggctggggtgggcacggaggaaccctcttccttcctcctccccgccctctgctcccccacagactggcctgtctttagtcagcactttcccaggctcccttctgcccaccacgtgcaaacagtggcgtgtcctgggcctctctccttgtagtgtttcttgtggccagcatccctcccatccaacagctgtgtggcttcctgactggcttctctcagggcccgcaaggatgctgccaaatggccagagacagtcactgctctgcacttcaaagcaggcagccctcggtggggcttgccctgaaagacagcgggccttcctcgatgagagcctgtgctggctcagggcctgtgggggctgcagctctgttccttccctgcgtccacgctcacatgctgaatgttgtgcaccacaggacaccctgctgggggctgtcgggagcatgctctgtgtttggggcagagacgggcagagtgagtctcagcattactgccgtgcagggttgagtctcagcatgacttccatgcagggggagtctcggcgtcactgccatgcggggcgagtctcggcgttaccgccgtgcagctgctggaagccactcgagctcctctgtctcgtttgccatgaagcccatgagagacactgatgtgtgtctcggggcttctgtgagaagagcttggttacccaccgggtcaggcaccacgtcggtgctgtgaggcatggagggtgctcacagctgtgcagtcagctacagaggcctttcccagcatccacatctgaccgggcagtcacaccaggatgagctcccaggaagagggctcccagcaagggagggcgcacctgggtgtgagcttggaggagggcagaggcacctgtcaccgctgaccctgggtgcagatgggcatgccgggtatactgactgtgctttcctggggcctgtctccctccaggtcagcctggggtcctctgggctgggggccatgcactgcctcctgtgggcagtgggatcagcacttccactttgctcagggctagagcaggctgctgcgggtgtgaagacttaggaaacgaattcggaaggaaggaaaggattttgcacttcccaagctagaagaacatgaatagagccgggctgccaggccaagggtctgtaagacggcggctcttcagagagtctgcaaatgctgagaaaggaaggctccccaagggcagttcctgtgggcgttactctgagttttctcatagaagtcaagttcttggaagacagcactatggtcaaagggttagtgaattcttgtgaccatttcccatggaaaatatcagagaaagttatggtgttgataaacagagtccctgtgctcagcagtctccacccacttgtcaagtaagataaagatttttggaaacaaaatttatggctgttatttgctaaagagagtaatacattcttagcacactctgaaaaataaccactatttgctgtatgaatgcagatgaaactcacacaaaaagatttatgcaggactgacatcgggtgtttgcagaaggttctccacgttcactgacctctgatcctcactgcagctctgcggggactgtggcccaaggatgagtgagcgtcaggtcgggccgtgcccttaatcccctggctgcccctcaccaccaggcagagaccttgctgggacccaaggagttaaagtgtattcagagatgaaggtgtttaggaaatgttctggaaccttccaaactgactttaggctgcgtgaggtgcttccagttcagtgcactttgggcccaaaagtgtttcctgtcttgttaatgcactgtgttgtgtgccatcaccgcatggaggttttggccatttttaaaaagtgaatgggccctcccagggtctagttggatcgagagaccactggaaaccctcaccaagctgcaggcaggtaggcaggggccccagagcaggcctaggggaagagtccccccggccccttggagggtctcttcacgtgctgggtgctgcctgattcctgcggtggcatggggaggtcaccccaccttgttctgaaccacagctctgggtgaggaagcctgtcaccaggttaaaggtcatttgggggttggggcgtgagaaccgcagtgccctgctggtagggttgccgcatgggtggccaggctacagcctggtccccgaggccgacccatcctgggaaccctgtgtgcagctccctgccatgcttgacctttgccctgtgggtggctttgagcgggggagacctgggtctggtggtgggcagggcaggggcggaggtggacttgggtctttgtgacactgcaccaattcccatggattctgccggcacccactgccctcctgagcagagcaaaggcagcagaggcggatgccagggtccggaggtggcatctactcatcagacactttctgtagttttataacaaatttggggcctcatgttagaccccagccagaccaggctcctgtcctggggctcagctccctccaagctgcttcaggttcagtttcctccatgcttacgaaaccgaagggcaacgggcacagtcagggaggcgtcagaggaggcaccggctccactgttcacaccgggaccttctgcagacggggctcccagcctcgaccagccccggaacccccagcacggggacgtccaatcttttggcttccgtgggccacattggaagaagaactgtcttgggccacacataaaattaacactaacagtagctgatgagctaaaaagaaggtctgtgcctaaagctcatgttttaagaaagtttacgaatttatgttgggctgcattcatggccatcctgggccactcacagttgcgccagagcctcgggagcacaggccgagcacctgccctgcttcacccagggacggggccctgcactgaccaggaggctgttgccctccaagtcgtccctgccgggaacagcaaagcacacaaacctccgagagacctaatggctgcatcctccgtgcagtgggcaccacgcttgccacctagaagagtgggtttggcagatgtcagttaataacaaggatgtaagttttaaaatcacgtgggggtttgtaaacttgaggaattacagcacaaacacttccatattattaaaagaaacagactgggagcattgattttgacttttcttccaagtacttatctatgatttaagtgaaactgagcattcagtgctctgtgggagtgaaaactgcaggcccttgcacttgcccactgattcattcattcacccatccacccactcattcattcaactatccatgcactcgctcatccatccatccactcattccttcatttattcatccatctccatccatccagtcacccattcacccactcactcatctatccactcactcacccacccattcactcatccattcacccacccactcacccacccacctattcattcattcatgtattcatctatctactcactctcattcacccattcattcattcatctgtccatccattcacctatccacccactcatccattcatgtactcactcatctacccactcactcattctttcattcattcatccattcactcacccatccacccactcattcattcactcatctggccactcactcatccacccactcactcattcattcatacactcactcatccatctattcactcattgttttattcattcatccatccatccatccactcacccatctatctacgcatttattcatttacccactcagtcatccgtccatcctcattcatttatccatccatctccattcatttactcatccacccactcattcattctttcatccacccactcatccatccactcattcatttgttcattcatccatctctatccactcatccattcattcattcccattcactcattcatccactgattcattcattcattcatctggttattcacccatccactcacttatccatccatgcatctgtctgctcactcatccatcctactcactaatctatccaccgattcactcatccatccattcattcattcatctgtgcatttatccatacatgcatctatccatccatctatccatctatcaatccatctgttcagtcattcatccattcactcatccatccatccacccactcattcatgcatccatctgcccatccactcatttattcacccatccattctttcacgcactcatccactgtccatctgtcatccatccatgtgtttggtgacggctcatgaggcctctgggggacagtcagcaccaggctcggtgctgggcaggtagatgttgtctttttcctcttgaagcttcagctaacagtgcagtggcttggggtttgctcacttatttttatctgtagctgttcaaataaaacagaagcagatccccggggaaaggatttccaggggccaaatggcgccatttccagcctgggaatcccagcttcttccccctgttgccctcacctaaccccagcacgccaacccattaccataggtcttgctcttcctaggtttagaagaaagagagtcagtgtgtacataaggagctcctggttctaaattccggcctcctgagtggtggcctctgctccatggggactcctgggggtgctgctctggagatatggctaatgcagggcttcaggccaaggtttatggacctgaacaagcagtagtgcagacaggggtgggagggttttgaggacaaagtgctctgtgtttggttctgcaggtcagggagcttatctgggtgcctttactcaaagccatttctgggtcttacatctttggctagaatgttctcaggacaatgtgaaatgtctttatctcaggagtgtataccagaatgttctcaggacaacgtgaaatgtctttctttcttgggagtgtgtaccagaatgttctcaggaaaatgtgaaatgtctctttttctttctctcaggagtgtatagcgtttttaggtttattcatcttagcttttctcttgctcatggtttaaccatctttcccctagtttgccggtggaattagcatatgctttctgcctccattactgtctcaaataatcaaacatgcaaattaggatacagtgcccagggctataaccctgtggtttcagaaaccccattcccataggtgtggcgaactgacaggagattggcatagtttttccatgaataatgcctttttgcaacaataaaacttggtattaatacagattacacattaagtagtatgactagtcttgattttgaaaaatagaacacacttgctgtaaagctgtggtaatgcaagcatttgtgtatagttaggccgtttgctcactagttcttagttgttttcaatccctggcttctaaacctgaaaggacaccttttgcatccctcgcaagtcttttatttcagagccagagcctcctgctttgagacaaagccccatcacttcccttctccttccaagcctagaaacctggtgccacttcgtgttgctccaggactccaccagggctcacttggtatggctgttcttgccttttcttggagtttgccaacccatgactaaaattggaagtgagagaaatgagggcaggcatgagggtgtgtgttccaggtctgcagccctcctggccttcagggcggccgccctcccaacagacacgtgagctgcacaccagctcaccctgacccttcctttctcttaagggagtaagagtttaagagcatcccatctttcctagaacacaactttgtgaaaacacatccaagcaggcctcaggagggtgttggcaaggctggggcggggcctccaggctcttcccacaaaaggtgtggcaaggccagcaagtgtgggagagaggtgggaaggaggcagaaaggccatgcagagccagcgcatgaagccagaggcgcgttgcagacggcgctgggtacctaccgcctctgtctgctactctgcaaaatgctaccagcgcctgctaatcctgaccttcatgcccccaggtgaatcccacaaccatcctgaagccgggtttcctcattcctgataatgggattaaaaagaccttcctgggtgttatttgtgaggatttcataaaatagtgtaaaaatgctgactcatacccagcatggagaggccgctgggactattctgccatgactgtggtctcttggtttagagcatttagggccaaactgctggcatggttgaccctaagctggagattggaggctgctttaaccaggctgtggccctagaatctgtgggccatggcaaaaggatcctgaagaagtttccggccggcctctgctggccaagtgacaggcaggtggttccaggactcgacagctcacttgtgtcgaatgtggacctcgtcagtgcgctttcatggataagaagacccttcattacagcctccatcctcacccagtaccaattttgtttcaccaatactataagtgcaaatcaatgcccgtgtgccaaaagaaaggtctttggggttttgagagacctttgtgtcaacagggaactaaggtctttgggttttagagacccttatgtcaacagggaactaagagtggggttttacttggaagcattcttgtcctcctgggcaggcctctcccctggacacacctggtagcacttcctacgcagctggaaatggccctgcctttgcttgttggtctcacagcagtcgtgccccggtcacttcccctcagttccccgggtggggcggccctctggctgccccgagagcagcctctgattaaccagctgatgcttatgttgttcagagaccctcgtagtgtgccggtcaatgcttgccttttctttttctttttccacaggattatttttacccaagatacttaggtaagtctcaattacttctctactctggttgtcgtagaggcatagttgggggtgcgtgtttcatgttggaggaatctcctcaccacgtaactcttggaaggaagattcttaatcacatggtgcacgtggaactgtccggaacatgcaggtcagaaacacaagtttctctctttattttataccacagctttattccgtgttagtggaacctcaggtgaatgctgttatctgcaaaccccttctctgagttgatgccaggctcagctccttgtcaggacgtgtaattgattttgtcctccggttttctgacctcagcactaatcacttctgaagtcattgaggaccccaaaggggtccatgttcatgtgggctgtattgactgatatttaccgtattcttaattaaaaccgaaaacactgaatagtgtttctgtttaatttgaagaacgggaatgccagacgttatctcagccatcagagcagctggtgcatgtggggcggcctctggagacccccactgtacacttgggaagggaggacagcaagaaagtgaaacccagagaccccgggtcagcccgtttaactgacaccatcttagagctctttgagagcatttcacttagaaggagagaaatgtattccagggtcttctttttaatgttgcaaagtgcattttagtaaatgtcctcttaaagggtccttccctgggtccatatctggaacaaacacagtgggtctggcactggcccagaaagcccaggcaccagcgaggactgagttctgaagcagggggtggccagcggtccacagcacacctgcaggaggccttccgctgttcatccgtgccgttctgcgcctggataagcaacagtaacccactgaagggccaggtcgagaggccccgcaccgttctgcacaacctcacgcttcgggttatccctggatgtgcatgtgccaggcctcgcctccccccgccgccctagcgggatgtctgctgtcaagctgtgttcagccagccagagagcatggaggggctttctccaaagcagagtggctttccagttaagcacagcgtttcccaatgggggtccactggaaaatgaagtttagcttttcgagtaccgtcaggaacttactgagcattcccggtgattctcccgtatggcaggaggagccccctcgaaacggcgggcggtgctttacgcacttgactgtgggtgcacaactccgctgagttggtggaggtggtttcctgtttgtcagggttggggctaacatgttttttattaacacaagctaagcggcattgtttctggaggatgatagcaccccaggtaagcagagtaactgcctctccagagcgtctcagaagcagaggctctgcagtccatccggtcttgtaaggatgactgacatccattccctttcttcctgcagactgcatcaacaagtatgggtctccgtacaccaaaaactcaggcttcgccacctgcgtgcaaagtaagtcggcctcctttgcgccttcctgggagcactgtgggtttgggcggctttaggcttggctgtggtttgtggagggccctgaatagttctgttttttaaggagctgtggtcccttgccgaggcctgctcccttttcgccaaactttcttttttaaacaagtaaattttgacgtttttagcaataggcaataaatgcacatggaacaaaatgtaaatgtttcacagagtgtgatgtgaaagcccatccccgcctctgagtcgtccagtcagacaccaccgtagttacagttccaagaatcttgtgcttagacatgtaaacatgtgtgagcggccttccgctcttcacacgcgtggcggcttagcacacacggtctgtcccgtgcctctgcaactctgtctgcacaggagaccctctcttagcgtgtctcaccttcacgctggcatttccagccggtgcatcatatgaacttagcccatgcatattggctgatgtccaggttatttccaatttccatcatttaaacaaaactggcgtgacatcctcatgcacctgttgcctcccacacgtctgagtgtctgcgggatgcgttcccaaggatggaatcgcagaggcagtcctcatgtttcctttggatacagatactgccaaattatcccagagccagccttagcctccgcccctgcaggggtgaatgaactgtttttttaaacttttgatctcttccaatgtaacaggcgagaaatgacatcagtcatttcaggtttttttttttttttttaactaatgagtaaagctgtccttcataggtttaaaaactgtgtatttcttttcctataaactgttgtttatattttttgcctgtttttctcaatttgtaggagtttgcacattagccattggtagtaaagttatcaaaaattttttcagcttgccacaagtcttttttattattttaaaattatcatgcaataagattgattgttttgggtgtcctgtatgaattttaacataccttcagcacaacccacacagctccccttgcactgggtctgtggtccgctggcgtcacgtgtgtctagttttagatgaaagtccagcttggtgagtccctgtgggcgctgagagcagaggcgtggcgggacggagtcatcctgggagaggcaggagtctcttcccaggcatggctttggagctggatcccagtcagcagaaggagtcagaggtggctcagtcccgctccccaagccccacgcactgtccgtgggcgtctctggcctcccggacttgtatcacagaccccagcccaagagacacaggcagaggaaatgctcagtgtaaacatgggaatgggagggtggccctgccctgtggcccggcctgccctgacctgcaaccatgcacagtagccaggtgccacgtagggcccaatgtctgcatttggggcagaggctcctgcgtgctcagaggagacaagcagatcctgtcacgcgtgttttatcttagtgattgctaaaccagtctcttcttttaaattctgtattcacacttgttatactctcttagttcctgggctttaggcttctccccaagattacaaaacagttacctgctgttaggtgttttcatctgtgacccgcccgtaatttcttttgacgtgatggatgaggtggggatctagactgcaggctcagttcctgccccaacaccacacatttgagtctgtctcaccccagtgcctcacctgctgccgtcctcatatgctgggtatttgggagattttctgccgggtttccacaggccgtggccacagctttagactcggcctcatgcacgcgggtgggtctcctatgccctcctcagtcttttttctggttgtcttgcttattttttaataaaactaaaccttaaaaatattcttaaaaacctaaaaaagccctttagatatttttaactgggcttgccattcatatatcggagactgtgtctgaacagtgttgcgctttcctaaccccggcaccgtcctgtccgtcccttggagcacttttcttcctgtgcgtcccgtgcttcctttgctcagttcacttctggctatttgcagcaaagaaggccgtccttttcaaggcgtcgcctcgcttccttgcatggatgaagaggagtgattgctacatgttcctttctgttcccgccgcccaatagagttatcttgttttggttatttcctttgtggcatcagcgtccccaagtgcggccagctggggagaggagggcaaggtcaagatccttgagtttgttccctgtgtgataggaagagaatctcttgctgtggctggtgccagaggcaacacatgcagtttctaacgggtccacctgccccaggccagaagctccggccactctccctgagccggccctcagaggctgccctgcctgtggcctggggctctcagcttctcctccagagcacgtggctggggcctctgatgttcgcgtgcctcaaaagatgcctggcggtgaagaaggtgctttggtggcctggccacagcaggcagccttgcactcccttgggaaggcgcctcccggaggatgcagctggggcagcctcacactctgttcctgttcattggttccctcgtgaaaattctctgacttggtgctcacggtgctgtcctggcttcagttcactggttatcggtcattgtgaaattaaagccatagccccataaagtccaaattcagccccagacaagcaggcccccagcgggccttgcatgggagcctgcggccctcaggctgtcccaggacccaggcggcacagtggacggagggaggaggcctgggaagagtgtaggctgcgttcccaggtgcccctgaagagcctctgcttccatttctttcctttcccacggacacacccagcttctccactgcgaacgcgcccgtcctgccatagcggccacttggtgcttggatttctcggctcctttgacccatgggtttccccaggaaggtcaggtccccacaggcggtggcccaggcagcggtcactgagccccggctaccgggatcccacccccgccacggggagtgtcccctcgcccttccctcgggcagacagggctctggtcctcgctcgtcaccacccagggaaaggccctggccgcccgcaccggcttcagattccagccacagccacagccgctccctcctgtccttcaacgcagtcatgggccaagctgagataaacccttcacctcctgaacaggcgctggcgcccagggcatgaccagccaggccaccgataccctaggcccagcttgcgggatggggatcagggaggtgggcgggggtcagggaggtggacggggtcagggaagtgggtgccctcgggggcctgcagaggtttctgtctccatcgctttccctgttgtgtggaggaaattccacagatatttgctgggcaccggctgactgtccacccctcaggtgtggttccgtccttgcatcctagaggtatcaatacattcccaacagggaaataaacaaatgagttgggggaggccccggggcaggtggcatgagtctggggaccgcttaagagctgggcacctggcaggagcaggcactgtccctcagcctcagggacagaggtctttccgaaaggcattccaggcaaagtcaagaccgggttcccagccctttgcatcacatgggcaggtgtccacttctgaaatggctttaatctctaaccaaacatcgtagcggcagcgcacagcatcccccagacatccctccatggtgggggcctctgaggaggtcaggttctggtgccggagggttgggccctgcacaggccgcctgccctgcacgtgtctgactccctcctgcccccagagcctcttcatctgaggccagggtggagaagcggatacgcccctcatttctctagttcaggccagacctccccgttccaggccctgctatgaccacatcgacgtctccagacgccccgcggacacagcacccaggtacagccgggcgacagcagtgtcagggatggggccccggccggctcctggcggctgtgctgatgcagaatccctggtcctggtcctcgtttcctcgtaactccgaaggccagccccagcccctgtgtgcttcagagtagaaagcgtttatagtgacctgctgaaaatagcatcttagaaacacttcgagacgcgagctccgtccacacccacaagtgttctgttgtcagtcatttgtgcaaaacaagcaaacggaggtgtagggaggaaactgtggggtgtactgaggaaactgaggcttatagaggaaactgtgaggcagacggaggaaactgaggtgtatggaggaaactgaagcatacagaggaaattgaggcgtatggaggaaactggggcgtatggaggaaactggggcgtatggaggaaactggggcgtacaaaggaaattgaggcgtatggaggaaactggggcgtatggaggaaactgaggcatatggaggaaactgtggggcgtacagagaaaattgaggcgtatggaggaaactgtggggtgtatggaagaaactggggggcgtatggaggaaattgaggcatatggaggaaactgtggggtgtatggaggaaactgggcatatggaggaaactgtggggcgtatggaagaaactgtggggcgtatggaggaaactgtggggcgtatggaggaaactgtggggcgtatggaggaaactggggggcgtatggaggaaactgggcatatggaggaaactgtggggtgtatggaggaaactgggcatatggaggaaactgtggggtgtatggaagaaactggggggcgtatggaggaaattgaggcatatggaggaaactgtggggtgtatggaggaaactgggcatatggaggaaactgtggggcgtatggaggaaactgtggggtgtatggaggaaaccggggcgtatggaggaaactggggcatacggaggaaactgtggggcgtatggaggaaattgaggcatatggaggaaactggggcatacggaggaaacgcgggtgtacggagcaaactgtgaggcatacggaggaaacgctgtgaggcatacggcgaagcgtcgcagaaagaagccagtgtggttgggcagcttccccaagaagcctgggactcgtagccagggcctctggtgagcgcggtgcctggacccgcctaggaggacaggggctgtgtctgtgccggccacaggcagtgactgtaagccctggatgagctggaggaactcagctttgtgaaccacagacccgcccgccgctcaccctggcaccgggcacccctgaccccggccaggtggggatggaagcggctcctgcactgacagccgagcccagaccctctggtggaaacgccacattctacagacctggtgggaaacgtcaccttgggagcctcaggaacagaagcgacacgctggcagtgagagcccatgcactgaagactcgacgtgcccccaccagggctgaccccttaggacgatgctggcccagtgccctagggccctgctggcccggcctgcacttttcccagggactggtccttattgaacttgtgtggaatcaatggaccggagccctctctcagccagcaggggggccctacccagggttccccacggagccctgtgtggctaagctgagcgtggctgagtcctcatgtggggctgagctgagtgtggaccgcgcccctgagcactgccatgctcagccccgagctgcttctgctctgccagcagccatgaaaggattctttgagctccgggtgtaattgtcgttctttctgccaacttcccggggctcaggcttgcgtaactgcactgtcgggggcttccctgcctgcctctgggacgtggtttgggtccgtgtcctggaagcgtgtttgtgagcagctcctcgtatgaatgtgtttgtgagcagcttctcggatgggggactgcttgggaagcagctgcactggcacgggttcccaccctcaggccctcacccgttcccctgacctctggccctgcaggagctgagcccaggtgaccaccctgagaaagggcagaacacacctggcctaaagccatcaagacacgtggagagggggcagctaagcagaaagaggggggcttcctggaggacccctctggcagtgcagcctgggcctggggtcctccccgccacacccagcagggagagttcaccagagatgggctaggggctggccagggaaggcagaatgttccgagtctgcctggaagcccccaggtcagctgggggttctgtgtgcctactccctgggaggtctgagctcccaggcctcacgccaggcagttcctgctcctttgccctcagcccttcccaccttgcgtccaggcctgctggcactccctcccagttgatctgagttttcctggagccggccccagggcccgccagcctattctgtcagccctaggccagcacagagggctcgggtgcccaggggctgcctcagcctgcgcccctcagagctcctccgggctggacccgagaccccacagccgccccgatctcagctgcgttgggcgcgcaggggtggggcagctgaacatgattttccactttgtgtccccaatcagacctgcctgaccagtgcacgcccaacccctgcgataggaaggggacccaagcctgccaggacctcatgggcaacttcttctgcctgtgtaaagctggctgggggggccggctctgcgacaaaggtacgtgaggctgaagacaaaggcggggtctccctccatctccgaccctgccctgatccccgctcctcactcccactccggggcacggccatcctcaggctgctctccgacagccccaaggaggctgcagccctgaggtatcctggagccccaggagaattgggaggagctgcagtctcctttctgggagcagggctggaaggaaaggaaacaccaagtgatgcctcagcacccactgattgaagggcggggggggaaatttcacctctgaccgtccttgagtgcagacctgtggtgtcagtggcacccactgattgaaaggcgggggggaaatttcacctctgaccgtccttgagtgcagacctgtggtgtcagtggcacccactgattgaaaggccggggggagatttcacctctgaccgtccttcagtgtagacctgtggtgtcagtgaagaccctggaggaagaatagctccagggcctggtggagacccatagtggagagcccagcaggccagcctgtcccctttggcaaatcctaccccacaggtggcctgggagggctttgctaaggagtggccagctctggcctggccttgtctgtcctcggcacccagaggtcactcctggcctgcagcctcctcctgcaagcacatgggcatccagggagctgagccctgtgggctgtgactgccagcagctccccaggctgagaccgcagctggggatcccccatgccctcccaccatctacctccacacgcaaggccaggaccaggggccatgaaacgctagggctgctgagtggggtgtgaggtccaagccctggggtccctctctgctccagggctgggctgtgcacctctaggatctctctctgctcgggggctgggctgtgcactcccaggctctctccctgctccagggctgggctgtgcacacccgcggtcccttcctcctgctccagtgctgggctgtgcacccccccggctccttccctgctccagtgctgggctgtgcacccccgggctccctccctgctccagggctgggctgtgcacccccggggtcccttcctcctgctgcggggctgggctgtgcacccccgggctccctccctgctccagggctgggctgtgcacccccggggtcccttcctcctgctccggggctgggctgtgcacccccgggctccctccctgctccagggctgggctgtgcacccccggggtcccctcctcctgctccggggctgggctgtgcacccctgggctccctccctgctccagggctgggctgtgcacccccggggtcccttcctcctgctccggggctaggctgtgacccctggtctccctccctgctccagggctgggctgtgcacctttgggatctctctctgctccagggctgggctgtgcacctctgggctccctccctgctccagggctgggctgtgcacctctgggatctcttcctaccgtagccaggggctgtgcacccttgggctccccttcaggcctgtgcttgttcccagatgtcaacgaatgcagccaggagaacgggggctgcctccagatctgccacaacaagccgggtagcttccactgttcctgccacagcggcttcgagctctcctctgatggcaggacctgccaaggtaaggccctggggtgaggcctctctcctctctcctctccccaccttctattttcggtcatgtctgctcttctgcaagcggctgctgctggctgggttcctgtggttctggatgggatggggcatcctgcagagactacacaagcccaggccagccgcagcacagggagctgctcggcaccacaccaggatgactcacccggcatctgagggccaggactcagggggccggcccagcccatgaggccacactgctggctgtagggcctcgtccattccccagagcctcacagagcctggaagtgctccaggcacttgtgtagtgagcttgtgggtcagggctccaggctagggtccccccgccgtccactctccccagcatccccagaagcaccccgttgttggtctccctctgtccactaaatatagccctgccctccccacttcctttcatatttcagtctggggttccctcagcccagggccagagctggggagccccaggacaccccagaaagtcactgtgaatgtgcgcgcccccgacgctgttccaggtgctgctgctgccactggccctttgccactttgcagggggagcaccttcctcctccctccccacgttgtatctggacatgcccaggcgtgtccctgagagtttctggcatagttcttagcgctgctgctgactgtccaggacaccgaactgcgtggacaggacagacagttgctcagggagaaacagccccaggatctggagagtgaatctgaccagacaggaggggccacaccccatcccccgatttcaaaaggcagctgctatttctgtccactttggtggttcccttccctgaccacccaggagttagccctgtgtgcagatgacgtgattcccatcttaacacataaacccatttccccgccgaggacagagcccctcccatcactgctctatccctgacctggaagacagcagcaccccaggtttaaagagaggtgaagactaggccgatcctgagagatgacgtctaaagcatctcccgtgggtccctgcaccagtcgggcactcccggcaaagtctaggctcacagttactgcccacagtgacagaggcattcccgtcctctcctcctcctccccatcttcctcttcctccccaccattccccctcctcctttccccactccccctcctcctctccccactccccctcctcctcccccccactccccctcctcctccccatcttcctcctcctcctcatcttcctcctcctctttcttctcctcctccccccactccccctcttcctccccatcttcttcctccccctcctcctcctcattcccctcttcttcctcctcattcccctcttcttcctcctcattccccctcctctttttccccctcctcctcccccatccttatttcccctctcctcctcctcccccacccctccccaccccctccctcacccctccccaccccctccctcacccctccccaccccctccctcacctcctcccccacccctccctcaccttctcctcttcctccctgcttctcctcctcctccccctccgtcgtcctccccctccgtcctcctccccctccgtcctcctccttcccttccccattctcctccccctccccctcctcctccccctcctcctcctccccctcctccccctcctctccatcctctccctaccccctcctcctcccctcctcccctccccctcctcttctccccctccccttctccccctcccccttctccccctcccccttctccccctcctcctcctcctcttcctccttcccctccccccttcctcctcccactcctactcccccttctcctcccccacctttctccgtgcccctgcctttgctctcctctggtgactaaagggctcttcatttcagggttgcccctcctaccccagggtgcttggccgtaaacagcatctgtcccacattagatgctcaagtcttaggattgtggtttaacccggtagtgaaaattgattgaaaccagtaaatgcttctctttggggttggggttttagtttcaaatgcccccggggggttactttttacggccccgtgtcctgtagcaccgtcatttaaatggaacagcacagcgtgcaccgccgccccccacccctccaccaagcagggcccttcccagctctccacctgctgggctgaagtcagccttcccagccgggccttgatcagaagcgtgcaccaacaccccgggagctgcccggtcaggggaggagggcagggaaatggggccagggcgcgctggccccacagagtctggatgcgacctctgggtggtgccctggccagtccctgcagccgcctgccccagccccgtctgagatgccgctgtgctgcggttggccggtttttttttgcttgcagacatagacgagtgcgcagactcggaggcctgcggggaggcgcgctgcaagaacctgcccggctcctactcctgcctctgtgacgagggctttgcgtacagctcccaggagaaggcttgccgaggtacccacgccacgcggtcaccctcgctttctctgacgcccaagtctagacacgggtgccagtcactgcccgagccggttgctaacaaccgggtgcttctggtgaaagaaagtctctttctccctgtttctatcagcctggtaatggcctgtgctaccaccatgcccgcacacacgtgagcacacacaggcacccatgccccttgtgcacatgaacgaaccgcacacatgcatatacaccgcatgtacacacgtgtgtacccttctccacctgcatagacggggcctctccccaaagggacggggagcagcaagcctccctctactgttctctctttccagccgccatggggagggccctgttggccgtagagcctctaagaggggccgtgcccccagtgatgggaacagtggggctgagtaggcagacagagagggtggggaagcccaggctgcctgcactgacctccatttcccaccacagctgtcggcccctctgtgctccgggggacacctcactgcacagcccagaccctgtgcttcccagacctgccttccacaccggcccggcagcgggggtgggtctggctcgttgggagcaccctcctgggacacctgcgacatttttattccctcaagaaagagcccgggcaggagcaggccgagggtgcaacctagctttccagtggggggggacgcgacccccaagccgcccccgttagaatctgcatgtaattccttgagcgcaccttgcgtgtggtttgagcaatcgcggtgtgatcccacggcgggacagcgtagaggcctccccggctcaccgccgcttccctctggctggcagatgtggacgagtgtctgcagggccgctgtgagcaggtctgcgtgaactccccagggagctacacctgccactgtgacgggcgtgggggcctcaagctgtcccaggacatggacacctgtgaggtaggcggcccctggccccgcgggcccttcacggtggttccgggggccctcgccggtgggggctttcgggagaaacacttccgtgaagacctggcctttgctaaggtgttggggatctccagggccatgtggaggtttgggatgagaaacgcttctgttccctggaagatgtttggttgtatttatagagtctctatggcaactcccagctcacagtggatcagcctggtgtggaccccagtgtgacactcacgggggcacggtccccactctgccgcgtgccagggagccaacgtgaccgacctgtcacaccggtgcctgtcacaccgacctgtcacaccggggcctgtcacaccggtgcctgtcacagcatgacctacctgtcacaccggggcctgtcacactggtgcctgtcacaccgacctgtcacaccggggcctatcacagcatgacctacctgtcacactggtgcctgtcacaccgacctgtcacaccggggcctatcacagcatgacctacctgtcacaccggggcctgtcacactggtgtctgtcacaccgacctgtcacaccggggcctgtcacagcatgacctacctgtcacaccggggcctgtcacactggtgcctgtcacaccgacctgtcacaccactgcctgtcacactgacttgtcacaccagtgtctcacaccgacctgtcacaacagtacctgtcacactgacctgtcacaccggtgcctgtcacaccactgcctgtcacactgacttgtcacaccagtgtctcacaccgacctgtcacaacagtacctgtcacaccgacctgtcacaccggtgcctgtcacaccactgcctgtcacactgacttgtcaccggtgtctgtcacaccgacctgtcacactggtgcctgtcacactggtgcctgtcacaccgacctgtcacaccggtgcctgtcacaccgacctgtcacactgacctgtcacaccggtaggaatgcagtacccacatgtggacgtttctgggcagggcggctcttgtctttcctcttcagcctgggcctgtgcctgggggttgatgagagtgagcatttatttaaaaagcaaaaccacaggtggaaagagtcaccaggacagcttctcggagtcgcagacctgggatgcagccgtggggctcttgggtctgggctgcgacgttcagggcttccagccagccctcgccttgaggttctttgcctcgctgcctcatgtactcatgcagagggtgtcggacccctgcgagatgtccagctcaccctggctgcccacggtgggcagggcaggcctggctcagccccagcccctccatcttccaggggtgtcagctcacaccggctttggttctgtcccccttcgggcagcgtggagaaaccacagcccagaacagggaactttccaggacagccatcttcaaggcatccatatctatttcataatagtgtatactttttaatgattctctgtaatttttgtatgcttgaaatatttcataatttaaaaataaagggtcaagggaaatgagcagggaaggagatgacggggacccccgagaagccctgtgggaagcggctgctgcaagcccgcccttcacctgggagtcccagtggggcaggtgtgacagcctctggggtctcagcagctagaggcggggtggccactcccgaggcacaggagggacagtggacccgctgcgcggccggggcgtggggctcaggggagcaggagtgaaggccacatccccgaccggcgtggcccccgtccgtggcaggacatcttgccgtgcgtgcccttcagcgtggccaagagtgtgaagtccttgtacctgggccggatgttcagtgggacccccgtgatccgactgcgcttcaagaggctgcagcccaccaggtgaggaggtgtccacaggaggcaacacaacttagaatggccaagacactggcttcacagggcccgggccagggttcggccagcagggaggggccgggcatctgcctgtgcccagtgctgactcatttctcctgtgggtgcccaggctggtagctgagtttgacttccggacctttgaccccgagggcatcctcctctttgccggaggccaccaggacagcacctggatcgtgctggccctgagagccggccggctggagctgcagctgcgctacaacggtgtcggccgtgtcaccagcagcggcccggtcatcaaccatggcatgtggcagacagtgagtgtgcggcagccaccccttccaggcctcacggggttctccctgagccagactcagctgtcactcgcttatgcaaccgttaggagatgagctctggggcctgcatctgctgcgtgccggcaggacggggacccctgccccgtttagttcatgctccgggagacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctccgggggacggggacccctgccccgtttagttcatgctctgggggctcactgtggtgctctaggcctctctgctatttcatcacgtttcagcctggctccctcagaaaggggccttgagtgcaacctgtcagtttggtctccctgagtttggtcaccctggctcaggtagaacccgtggttctcagccccaggggaccctgggctgtgtctggaggccatgctgtttatcccgagcagagtggggaacagaagccagggctgcttgacgctacacgcagggtgccccaccaggggaggaggccgccactgaacccgcaccacagcccagagctcccgccgtacgtgtctcccgggccgtggccaggccaggcgccgcccgcccacccttccctgtaggacggcgtggacgctgcggtccctgagccctggctcccagggcctgctggtcagtgcggccatgcatgccaagggtccaggtgacctcacgggagctgccccttgccagagacgtcctgaccacctggaccccagccccatgggcaacctgaggggtcctggtcagacctgcacttgggcagctgtgggcagcggtaaaacgtgcccaccccacatccccatccgtggagcgagagggcctgtaagcaaccaggctcccgcccacagcgctgggcctccctcaccatactgggcttgcagaaggaaacgttgggaagaaaggtggaaagcacgtcttgcccttcagaaacattgtagacttgtatttccatcctgcaaagcaatgcctcgctccatttttcccaacctcttaaaggagcagtatctccaagagcaggaggctgttctcagcaaagctacagaaagcaaaggaagcagaagcagtttcagggatggagccccggggaggagggccccagggcaggtggcctgaggcgaggtcgcctgggggagcggtgttgcaggggatggagccatggggaggaggggcccggggcaggtggcctgaggcgaggtcgcctggagggagtggtgttgcaggggatggagccatggggaggaggggcccggggcaggtggcctgaggcgaggtcgcctgggggagcggtgttgcaggggatggagccatggggaggaggggcccggggcaggtggcctgaggcgaggtcacctgggggagcggtgttgcaggggatggagccacggggaggaggggcccggggcaggtggcctgaggcgaggtcacctgggggagtggtgttgcaggggatggagccacggggaggaggggcccggggcaggtggcctgaggcgaggtcgcctgggggagcggtgttgcaggggatggagccacggggaggaggggcccagggcaggtggcctgaggcgaggtcacctgggggagcggtgttgcagtgtagtcccgcccagtgactcacagcggccgcagcaccccaccaagacaggcccttccccagcaggggtacctcatgaggacccctccccaattccaccctctctagctgctgcccaaacccagctgacccgaatttgtaccatgtttttgtgactcagttcaaacccaaatacctgaaaggtgttttcacacaggaagaaggatattcttctgaagctcaggaatatagtgtatctagcattagactttacaggttttctatgaggaaaggttttggtgaccacattgatgcatcgagggccctcctggcccagatgatgagcagggactctctgaggttgggaccctcttggctcaggtgtggatcaggtggtctccttgaggtcaggtccctcttggctcaggtgaggatcaggtggtctccctgagattgggaccttcttggctcaggtgtggatcagggggtctccctgagattgggaccctcttggctcaggtgaggatcaggtggtctccccgaggtcaggtccctcttggcccaggtgaggatcaggtggcctccctgagattgggaccctcttggcccaggtgaggatcaggtggactccctgaggtcaggtccctcttggcccaggtgaggatcaggtggactccctgaggtcaggtccctcttggcccaggtgaggatcagatggtctccttgagatcaggtccctcatggctcaggtgaggatcaggtggtctctctgaggttgggaccctcttggctcaggtgtggatcaggtggtctctctgaagttgggaccctcttggcccaggtgaggatcaggtggtctccccgggtcaggtccctcttggcccaggtgaggatcatgtggtctccctgagattgagaccctcttggcccaggtgaggatcaggtggtgtccctgagattgggaccttcttggctcaggtgtggatcaggtggtctccctgaggtcaggtccctcttggccaggtgaggatcaggtggtctccctgagattgggaccctcttcgcccaggtgaggatcaggtggcctccctgagattgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggcccaggtgaggatcaggtggcctccctgagatcgggaccctcttggcccaggtgaggatcatgtggtctgcctgagattgagaccctcttggcccaggtgaggatcaggtggtctccctgagatcgggaccctcttggctcaggggaggatcaggtggtctccctgaggtcgggaccctcttggctcaggggaggatcaggtggtctccctgagatcgggaccctcttggctcaggggaggatcaggtggtctccctgaggttgggaccctcttggcccaggtgaggatcaggtggcctccccgaggtcgggaccctcttggctcaggagaggatgagtgtggtttttctcagttgggagccccttcagaacgtgcactcccatcttttctcatggcgctgcctctcttcagatctctgttgaggagctggcgcggaatctggtcatcaaggtcaacagggatgctgtcatgaaaatcgcggtggccggggacttgttccaaccggagcgaggactgtatcatctgaacctgaccgtgggaggtattcccttccatgagaaggacctcgtgcagcctgtgagtactgtacctgtccctgtgtagacgcgccgtgtgctgggatcccgggaacggtgtcaggaagcctcagtcacaccctgccctgtgtttaccattaaccaggtgtgaggaggacctagaggaaggaaaggtttcctagagtttgacaaagtcgccgtacagctatgtcattaattttaccatctctttttatgagacctaagttttcatctgaattgataataaagttgtctatttttcaatggagataagacacaattaaattattattattttttttgagacggagtcttgctctgttgcccaggctggagtgcagtggcgcgatctcggctcactgcaagctccgcctcccgggttcacgccattctcctgcctcagcctcccaggcagctgggactacaggcgcccgccaccacgtccggctaatttttttgtatttttagtagagacggggtttcgccgtggtctcgatcttctgacctcgtgaactgcccacctcggcctcccaaagtgctgggattacaggcgtgagccaccgcgcccggccgaaattattctttaacagaacagtaaacttttttggacaatttccaagaacattttgggttttgtaactctgccgtgagtctcataaggggaaaacagccatgatgggcggtcagtgtgggccattgctccaggtcccgccttctctccccttcagcacagcacacgcccgtgcccccgacctgtgtctccagcccccacgtgctgacgtctaagccgtcatcctgggtattttcacttccacaccaggcaggagaaaggcacgcatgtcttcgcgtctttgggtgctgagtgtcggcagtgcctgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtgtaaagtgaagaaaccttctgtgaaatggccaccaccgatgggactggcccgtttctgccgtagagctgcacataccagggccgcgaaggcgccacccaccgactggggcatccggcatggggcttctcgctcccaggaagccacggagatttctctgcctttccagataaaccctcgtctggatggctgcatgaggagctggaactggctgaacggagaagacaccaccatccaggaaacggtgaaagtgaacacgaggatgcagtgcttctcggtgacggagagaggctctttctaccccgggagcggcttcgccttctacagcctggactacagtaagtcttggctcttaccgttggggtggctgtggctgcaccttcagacaggcatacgctgaaagcaagcagacggcctcagatggcagcgtcaggacaagctgaggctcctccggttccggggcagggatgggtgggcggggtgggcggaggtgcgggcagaggcccacctctcaggatggccatgcaggtcactcagttcagagtcagccagtgaagaagaaatgagagagatgtgccgagaaggtgcctgcgaagccagtgccaggaggccggggagagaaggtgcctgcgaggccggcgccaggaggcgggggagagaaggtgcctgcgaggccggcgccaggaggccggggagagaaggtgcctgcgaggccggcgccgggaggccggggagagaaggtgcctgcgaggccagcgccgggaggccggggagagaaggtgcctgcgaggccggcgccgggaggccggggagagaaggtgcctgcgaggccggcgccgggaggccggggagagaaggtgcctgcgaggccggcgccgggaggctggggagagaaggtgcctgcgaggccagcgccgggaggccggggagagaaggtgcctgcgaggccggggaggctgggagccttacagggtcctttgcagaaagtccggagacagcacagccttaggactcgtccaggggcacagagaagctctcggtaacatggtggacaccgtggtcaccgatgacccggtgagacagctacaatgggaggtgtgtaaaaacagccgtgaagctgcctgggggacagtgaacctaggcctgaaaaagggaggacagggtggatgtgagctgctggcccagtcctgtgacgccacgctgccgccctccccagtgcaggctccgggggtgctgctgtgaggatagtgttactgctcggccccaccctgcctcacattcccaccccacgtgggccccactggggcaccacagccctgccctattcctggacaccgagccgtttatggtgaagcccccacacgcacagagggcaggcagcgccccctccgtcagatctcagggctgccggccctcaagcacccagcaggaaccccaggttcaaggggatccacgcggagcaaaggggagggtcctgccccgtcctgagccagatccagtgtcaccgtctccccccgggtgtcaaaagcgtgaccgtgtcaggaaaggcatctgagaaaagcgccatctgccactggctggactgactgtgcacacgcgttctccctcagtcttgatttttggacttccaaatctagagcatcataatgtttgacacgaaatcatgtcatatgaaatgcttaaatcctttttccacttaatatcatacacatttctcaggggtaaccttatgcaggcatcacaggggccatttccagtgactgccggccgcgtctgccggccctttttggtctatccggacagaagcagttacagctccatgcatttccagtgaatctcaaactataccagtaacgtctcttacaagacagaggagacttgctgggaatggtagtactggcctggctcactctgcagcgactctgctgggctcaggcttgcagatctccgggtctgtgcagcctccatgcaaggggccacgtggagccgggaaaccttcccggggagagcagaggccggtgcccttgtgaagccccgatggccaacatgtgcctagcctcctgtcaggagcttccttttttttttttttttttttttttgagacggagtttcgcctttgttgcccacactggagtacaatggcacgatcttggctccacctcccaggttcataccacaacctccgcctcccaggttcaagcgattctcctgcctcagcctcccgagtagatgggattacaggcatgcaccaccacacccagctaattttgcatttttagtagagatggggtttctccatgttggtcaggttggtctcgaactcccgaccttaggtgatccacccacctcagcctcccaaattgctaggattacaggcgtgagccaccacgcccgactgggagcttccattttaaagaacaccatcatctctcccttcacaggttatgggaagaccggcaaacaggagactttttgttgttactttttgattctgttgcaatatttttgttactttttctgattttgtgtgtttcggtgccataaatggttgttgagaactgatgtggcgggtaccagctagggacaggcaggacaggcgatgtgggtttcaggcgtacacagccccgtgggaaagagacagggaaaccagcacaattcactctgaccccaaccttggcctgcagtgcgaggcgcccagtcacaaatgtgtacacacagtgatttggggtcctttttcctaaaacagcttctttatcaggactttggaattctgggtgagatagaaacactgaaaacagggcggaagttttttcttctggcttcttagtccacggagggctcagcgtggagaggatatgccgtggcattctccctgggagaccacacatgttcccgacagctcagaccccagaccgcatgtgctcctgacagctcagaccccagaccgcgcgtgctcctgacagctcagaccccagaccgcaggtgctcccgacagctcagaccccagaccgcgggtgctcctgacagctcagaccccagaccgcgcgtgctcccgacagctcagaccccagaccgcgggtgctcctgacagctcagaccccagaccgcgcgtgctcccgacagctcagaccccagaccgcgggtgctcctgacagctcagaccccagaccacgcgtgctcccgacagctcagaccccagaccacggtgctcctgacagctcagaactcagaccgcgggtgctcctgacagctcagaccccagaccgcgcgtgctcctgacagctcagaccccagaccaccgtgctcatgacagctcctgtccgcatgctatcttaaactctcagcccccactgggccctgtgctgctacctgaaagctgcaggtgagatgcgaggcacgaggccacgcacgctctgaggaaggagctgtcaggcgctcctgaaacaagaggacatcggagggaggcagggacaggcctgcgtcccatggtgcacagcctgtggcccctcagacgggcctgtgtggcctggtggtcacctacagggcatttggaagtggggtactggtgtggccagggagaaacagcctgggggtccccggtgcctctgggctccgggccaagatctgaaccagtctgttgagttttccatcacgtcccagatccggggctgtctgcacagcttcccaccccggctgggactgcatctctcgaggccctgctccgacctcactgtggcctctccaccgtgcataccaccctataatgcaccgctttcattgcagtgcggacccctctggacgtcgggactgaatcaacctgggaagtagaagtcgtggctcacatccgcccagccgcagacacaggcgtgctgtttgcgctctgggcccccgacctccgtgccgtgcctctctctgtggcactggtagactatcactccacgaagaaactcaagaagcaggtagggcctccgccacccagggcgtcctgaccggctcgacccacgggtacgtgggctgcactccctggcaggggacgaagggggcccgcggtgggatccccagggacccccaaagcctctgaccagaggtctgatgagccaagcccggcgtgggccacgcttcgggctgcgggggttgtttggacaccaggtcaccgccacacagctgagggggccggcgcctgcgagccacactcggctcacagtgtgggagcttttcccctgttcggttgggcagatggtggctcacagcaatctgaattagtctctggtgtttaagtcagatgatttcagcaacaaactcagttttccaatttccctggaaaagtcggatctgtgaccttggccggtcccccaacagcgtctttccgtgggggacaccgggtggagctgagtgcagctgccccttggacaaggtccccccacccccggtcctcacaataagtcagctgtcctgggctgggggactcatgctgttttccccacagaacaatcaagaggtgacagaaacagcttttattctctcgctcgtgtgctaaggagggagacatgggtcaaaccagagaggctcacgttctccaagtctgcccaccccggggccacagagccctcccgcttgctgggatacgacagacaggcttggttcatgcaaatgctcgttaccagggccagacccaatctcagcatctggaataaacagctgctgttatgtagcaacagccgacccctgggctgctgggctgtggtgccagcgtgagtgcccaccgggctgggaggccgccaccgcagggctgggtcctgggtccccatcagggccaccccagttcctggtcaagtgcagcctcggtcttgtgtgtgcctggtgcctggggctggggttgaccctctcacacccaacctgggggccacacttgttcccccacagcctcccaggctggcccctggctttacgtgcagagaagctgagccccaggtggggtgggggtgtcatccacagtcagcgagcatccagacccagggctgcagggaaccctggacggagacaggcgtgcggcgtaggggtggccagcagctgtgaggaccagcttggacctaacagctcacgtaggggtggccggcaggccctgaccacacctcggtctcctgcagctggtggtcctggccgtggagcatacggccttggccctaatggagatcaaggtctgcgacggccaagagcacgtggtcaccgtctcgctgagggacggtgaggccaccctggaggtggacggcaccaggggccagagcgaggtgagcgccgcgcagctgcaggagaggctggccgtgctcgagaggcacctgcggagccccgtgctcacctttgctggcggcctgccaggtaggtgctccctgctccgctcaacccgggtgaagagctccagggaggcccagcttggtcaccccagatctaacctggacaggctggggtttctggtagtgaatgcggaagaggacttgtgttttaagaggaaggagaagtccaggtgggtcgttagtggctattatggtgtctcggtgctggtcaggtcattggctgagactgagaaacacgtacgggggccggcattggcctgagtcaggccccacgaacctgcatcttcagggagcattcgtccacacccatcagaccagccccgggggagagggctgggcagacctcgggccaggctgcagttgggacccgcggctgtcaccgcagctgttagcagcgaacagagtgaccgccagcccctcccatgtccagcagggcgtcctgccgtgtcccatgggctacacagcacagaggctgggaccggggatgtccttgccatgagctgggagggtcagcggaaaggcacgtgggagccggcaagtcctcggctgcccgcaggttttcacttgcggcaaacggcaggatttctctcttggctgccagacacagactccacttagttttaataaacagagctttgaagaggatgagagcgagccaggaggcctgcagcctgaatgactcactgggcacagaagaagatcacgtttaaccgatgggactgtctgtgctcccagcggggaagggagggctggcgtctgcagagcccaggctggcagatgcctcctgcttgtctgccgggtctgcggccaaacgaacggggaccgagaagttagagaagaaagggaaaccctgccctttcggagggaacccggggctggccacaagcgctgccgggggtgggggggccaggcggggccggccacgtggtgagctaagatatgttgttctctccctgcggcccagatgtgccggtgacttcagcgccagtcaccgcgttctaccgcggctgcatgacactggaggtcaaccggaggctgctggacctggacgaggcggcgtacaagcacagcgacatcacggcccactcctgcccccccgtggagcccgccgcagcctaggcccccacgggacgcggcaggcttctcagtctctgtccgagacagccgggaggagcctgggggctcctcaccacgtggggccatgctgagagctgggctttcctctgtgaccatcccggcctgtaacatatctgtaaatagtgagatggacttggggcctctgacgccgcgcactcagccgtgggcccgggcgcggggaggccggcgcagcgcagagcgggctcgaagaaaataattctctattatttttattaccaagcgcttctttctgactctaaaatatggaaaataaaatatttacagaaagctttgtaacaccgcgtggccgtcatctgctccccgcggggttctgcacacgtagcagcgtttgggatgagcggggctgccagggctccaggccgcaccctcagccgctccaaagatccctccctcttttctgctcccagcctggttgggcagccacggtctgctccccaggagcctctgactcctctggtagtggcggcaggggctggagcctcagtttacttgttctgtaaatgcggagaacgccctgctcggcccccaccacaggcagccagtcattgctgagtgaggagggcttggcacacaaatgcaggctgctggggcagcggcctctgagccaacctgggagggaccccgagctgggaccgagggccggaagacaccgaggcagcgcctgcacccctgtgccattcccgtccccaccctcctgcacagatccacttgcttccgggcctcaagtgtgttctgttgagaaagggaaactgctttctctgtgtcggtctggggtagagcttgccaggagcaaagccagccctgcttcccgcgtccccactggcagggtccccatgtccctcagcctcagcttccttgtctgcaaggggtggagcggtcactggtgctctctgaccccagcaggccacaagtctgcagggaaggtcagggcagccggaacgcggccaggcaggtgcctgaaatgcagtcgggaccctgcctgcctcctggaaggatgtcggagccgcagctggtgggggccacggagtcactgcttctccttggtcccaaggggacgaccaagactcatggcttgacgctcccgtgggacgcggccacctgtgctcgagcctctgggccaaacatgggtccccagggtggatgcggtcactgcaggggccacacgggggatcagggagggtttcagctctgaggcccaaaccaggattccactttaagaccaaacccccacccgtgctcggagctccctgggcaggagtgagacggggcagctcggagcagccccacctcccaccagtcagtcccagagctgcgcccaccgggcaggacaggctgtgcgtcggggcatctttgcctctgcctggctggggtcagcacttgacctagagaaaagtcgggtggagaagaaggatagaatccatgagaacccatccagggataaatcgccacaaatgaactgcaaagaggtttctagaaagaggcctgtggctttgaaggccacaggggaggccccgctggctggactgacaaggtggcatcggccgagtgggctcctgaggggcagcctcgggccgggaaggagcggcttccctctggcccccggcctgacggctgtggaatgggcagagcttctccaaggctcgggagccagcaacactcatgcccacctggagggaccctgcccgcctgggccgagctcaccccacggatggacggccagccaggcaccttgccaggggccatgcacagggggccccatcccctgccgtccagagccgcccagctcgtctacgctggagcctccaggccctggtggtccctgagggtccctggcaggcccaccctgtgtctctggggctcttgttgaccggtgccagttatgggctcctcgggccacatcccatgaccctgcgccatcgtgggcatgatgccacttgctctggacacgccgggcaagggcctcttgttctccccaaaatcttggcagcacctgggcagaagttctgttgattgagggctgcagcctgaattcaggacttcaacctagtctaagaggtattgcaggcaactttcgcttcggtaccgtgagaaaatagtgacgggggaggccctggcctcagagggcagacgtcaggctcctgccggctcccttcggaaacgtccatctgccgccagcggccccgcgtgtgtgtgacggctctcgccagcctcgcccagcagcacgtggaccttccgcaggcagatgcgctttctccactcgggccgggacagatggccaccggctgctcacacggtcggggacccgcagcccaggcctccacgctggctccgggatgtccaggtgctggttgggctgaggatggtcgggcccagggctcggatctggccatcagcacagaagcccagttctgggaggcccaggcgtggatgctgacggctcgctaagcaggccaactcgtctgaccccgacgatgccagagccagctgagcagagctccaagaagcccgtggaacacagccccctgggccccaggagagccctgcactgcccactgcacggcctcacacggccacaggggccacagccgcacgctgggatcccaggctccagcccggcaccgcggcgtccctcagatcccggcctccagcccggcaccgcggtgtccgtcagatcccagcccggcaccgcagcgtccctcagatcccggcctccagcccggcaccgcggcgtccctcagatcccggcctccagcccggcactgcggcgtccgtcagatcacattggtgggtgccccccagtgctctcccataatgttccccagccggctgggagcctgctcctgcccaacctccatcctccccaagtcaagacggccaggagcaaaaacaggcaacggccagtctcagggacagagacgtggggaggcccccacagacacaggctacagtcaccagtgtcctcaggacacaaccctccgcctgggtttctgctctgcctccagacgaatcaggaacttctgtttcctagtattgttttcttagagttccgggggtgccagaagttataataaccactgtcccaaacaagcaaaaccaatggtgctaggaattgcaacacagaggcccagccaggcctgtcacgttggcgacctggcaccctccacaaccaggcatgtctggggtgtgcaagaggatgggaagacagagcacgtggtgcaagtgctggtgccctggggaggcaggagggatgtgccccttagagggaggagggatgtgcgccctggagggaggagggatgtgccccctggagggaggggtgatgtgccccgtggagggaggggggatgtgccccctggagggaggggggatgtgttccctggagggaggggggatgtgtcccgtggagggaggggggatgtgtcccgtggagggaggggggatgtgtcccctggagggaggggggatgtgtcccgtggggggaggggggatgtgtcccgtggggggaggagggatgtgtcccgtggagggaggggggatgtatcccgtggagggaggggggatgtgtcccctggagggaggggggacagccctgactctgggctggagaggaggaaggaggttgggcatgtgttttgcaggtggggtcctttgatgtggccgcgtcctgtgcacagcagatgcagcatcgccccctcctggacacccagcctcatgacaacacgaaatgtctccagaggttggccactgtcccctgggcccgggcacctctggggaaacactgctctaagcaagaaggaacgtttcgtcctacttcacgtaatacggcaaatatgaacatcagatttttaaatgccaacggaagcataaagcaaatgtacagccgggctaatcccagcacagcccatttgtaggagaagctccagccacagcccctgcctgcaaagcaagaagggtcacctgccccagggtcaaggactccacgaggggagagggggagggtccgctccatggtgcccttgtttcaagcacgttttctgcttactgaattccatcagttaaaaggtctaggaaacagaaaaggaagtggcgcgtgtcgccgtctgaggatctgctgacgggccccggcctcgtggaatcctcttctgcctctgtgggtctccagagtttcggaggcatctctgctcccaccgcggggtctggtggccacggggtccccaagtctgcaggaggagctgctctgtgtggcgagggtgatgaccatggctcttgttcactgagcagggccggtggccagcactgtccaagtcaccagtgcagccccataaggccatcttcacaacatccttggggcccgtttctcccactcccgtttccatggagatgtgattcacacagcaatagccacgcctcatgagtgcagagcatgggtcggtggtcagtccatccacggggccgtccacccatcactgccatctggctcccggacactcctcttcccacaagaactcgtgtccctgaccagtgactgcacctctccccatccagaacacgcttagaacacacttgcctccccgaaaagaactcgtatccctgaccagtgactgcacctctccccatccagaacacgctgcaaacacgcttgcctccccgaaaagaactcgtgtccctgaccagtaactgcacctctccccatccagaacacgctgcaaacacgcttgcctccccgaaaagaacccgtgtccctgagcagtgactgcatctctccccatacagaacacgctgcgaacacgcttgcctccccgaaaagaacccgtgtccctgagcagtgactgcacctcctttcccagtcggcttctgtctgtggacacgccttctctggacactgcatataaacagaacacagtcttcatgtctggtgtccttccctgagcactgtgtgttacagcctcagcacccgttagagcttccttcctctccgtggccgggtgacccgcgtgtggatgggccacgtcctctccctctctgtggctgggtgagacccgcgtgtggatggaccactgtagtattctgttttcacactgctaataaggacatacccgagactgggaaaaaaagaggtttaacgggacttacaattgcacatggttggggaggcctcagaatcacggtgggaggcaaaaggcacttcttacacggcaggagcaagagaaaatgaggaagaagcaaaagcggaaatcctgatcaaccagtcagatctcgtgagacttactcactatcacgagaatagcacgggaaagaccagccaccatgattcaattacctcccgctgggtccctcccacaacgcgcaggaattctgggaaatacaattcaagttgagatttgggtggggacacagcaaaaccatatcacccatgtcccttcctctctccgtggccggtgaccccatgtggacggaccgtcacccatgtcccttcctctctccgtggccggtgaccccacgtggacggaccgtcacccatgtcccttcctctctccgtggccggtgaccccacgtggacggaccgtcacccatgtcccttcctctctttgtggccgttggccccatgtggacggactgtgtccctcccccactcagtagttgcctctgcttgggagctcttgtgagcagtgctgctgtgtgaaatgtagaaactgaggcaggaggagactccctgtaacccaaggtcccaagctaataaggtggggccagtctcaacggacccctgcccagggcaatgctctgaccctgccctcctcagtcacaacctgcagctacactaggcccccacctctgagctgcaggagaagcctgtctcctgtgctgtcccagtgaggcagggagtgcaggtggggccacagcaccccaaaccccccagcaccccctgccccggggccacagcacccccaaaccccccagcaccccctgccccaccatcccctccaccccatctcccgcggcctccagggtctcactgacctcggctgtgcatgggaaccaagtgagggcgggattgggagcccatccctgcagaggaggctgggatcagaaggccccagcggagcccagagagggggttcatcagaccgtgactcaggctggcagagcttggtggccccagacaggatccgtccacatgagacaggtgcacctcgagagcagccgccgcccacactgcaggccaggcattggccggagccctgcgccaggtgggagctgccctgggacctgggggaccctccagccaccacgaaccttgagtcaaattgttcacattctttgtggctgggataaaggataaggacatttttgtggcaagaacaaaactgttgaccttggagttgaatatttttgaacagcttttgactctagacaagattaaaagtcgggaaagatcgatgttgtgtttgggggaagctggtgagtgcagcctcggggaagcactctgatgcccccacaccgcaccctgcgaccgagggctgacatgaggggaaggagggttattcctgtgactttgctggccagagctccagggggcatagactccctgcccagacctgcagttcagcttctctgctgttcgcacccctaggacaccaagaggtgctggtgcctgcaccaggcagcttcgggggcacagcccgagctccagggtgcccaggaaccgcccacacaagaccacggcaccatcggcgcccatagagccttccctgaggtaaagtgagagccctggggactcgggaaatccgtggcacacttttcttcccccacaggcgctcgtgagtgcatctcccggcgctccagaaacctcttggtctctgctgcttgttcagcttcttactcggagccaggcacccacagccctggaggaactgggcggtgatttccagacaggacgccgcacctccggctcgtgcccgacctcccggactggttcaaggccagtcagccctgagaggccaagaccacattctcctggacagcaagcttgtgaggctggattttataagataaaaatgacaagcagtggcgggttcacagaccagagctggctgcaggcctttcagaggcccgttagggcccctgggcccagccagccaccgttcatgtgtggatgtgcgctgtgggccttctgcccaggagcgctggacacaggatgagaccctccgtcgggcagagggaggctcccgggcagcggagggggcagaggctgtgtgagaccctccatcggacagagggaggctcccgggcagcagagggggcaggaggctgtgtctgcacgagtgtggctcccctccaccttatcttttttctcccagatccaggactgggcaggggagaaagtccccgctccacctcccaggtgggcactgttccgtgaagtaagctggagacctcagacccacacgggagaagagcggtacttgtttatcgtaggcacggggggctttgcagggagggacgtgaggccctgagagcggtgaggcctggaggcgccagcttccgaggggagagggagtgactggggaaccgtgagcggcccacagagcagagacggcgacttggtgtcttgtggcacgtctggggagcaatgggatcacctctcgcccgccctcccgccctgggagtccctggttccctgaggatctgacttcaggagttcagagaaagcctctccccacatccaacacttttcaagagacttcggctactttggggtggcgcatcctgaactcctgtcactggggcgcctgtgacccacccgggacccgtgacccactcgggacccgtgacccacccgggacccgtgacccacccggggcccgtgacccacccgggacccgtgacccacccgggacccgtgactcacccggggcctgtgactcacccggggcctgtgacccactcgggacctgtgacccacccgggatgcctgtgacccacccgggacctgtgacccactcaggacctgtgacccacctgagacctgtcctgtgacccacccggggcctgtgacccacccgggacctgctgcttcccaggcgtgctcacccgtctccccaggtgtgcccggcaggtgcatgctgggcccgcggggagctaagctggtttccacagggagtgctgcggccccagaccctgagccaaaggaccccgaaacaccgtcccccaccatcccagcggccaggggtcctgagacaaggtgcggtgagggagaagccgcggaaggacagcggaagcccaggcgccgtagctgggagacagctcaggggaagaccctcgtgccagtggcccaggcagatttgcatccggggctgggaaagacaaccgggcccctggattctaacaactcacaggcggttagacacagcgctgggcgttggagccgaagcgtccttcccttcctggcatacgtcaggagcacagcacgaggggcgggtggcttctgccctgcgcttctccaggacacagatgcacacacgaacgtgtaacgcacaacacatgtccacaaacaagaacacacaggcagggaggccggggctgcactgtctttgcaaaatcataataatagctaattaattaagggatgtgaaaacaccagaacaattgctctcagaggaggaggccgggtgggaactttcagcgccatttgatgtgagcagagcccaagccaaggtgtcaccagcctgggtctggagggccccactccctgcctggttccagcctccctcaccagtgtgcccagggaggaaaggaggggacagacttctggaacattctcccgggttctctaggaggttggccacagaagcgggatttctagaggctgccttttttttaaaaaaaaaaacaaacaagttatcttttactccacgcctctatcagggtgcgtaggggggtggcttctcccccgggggaaagtaggtgggtgcgtagcacggtggagcctggccgggaagcccagagccagagctgcttggagaagggggctgcaggtcctcagacgaagccagggcagaggagggcgcaactgggaagcggctgcagggctgcaataaacagagagggccctgggttagcaggtgagaccaccccgtgccggaccacagggaagcctgacatataccagggccactcacacgctccccacccaccccgccaacccagggccacccgcagactcagggccattcacatgggccccccgcagacccagggctattcacacaggccccctcagacctagggccactcacacagggccccccgcagacccagggctattcacacgggccccccacagacccagggctattcacacgggctcccacagacccagggccactctcacgcccctcccctcccccggagacccagggccactcttacgtccccctcccccaccgcagacccaggacctctctcaccggcccccaccccacagacccaggaccactctcaccggcccccccacaggcccaggcccactctcacgggcccccacagacccaggaccactgtcacgggcccccaccccacagacccaggacctctctcaccggccccccccacagatccaggacctctctcactggcccccaccccacagacccaggaccactctcacgggcccccaccccacagacccagggccaccagaaggagcagccccagcccggggcagaacaggagagggtggccggggcctcactggcacaaccttggcctccacagctgcatggggcagggggtggacgccccaggaagggtgtcctcagaccacatcccacttcctcacagccagcgagcctctgacctgactccaaaaccaacagttagggtccaccaggcctggggcccctgggctcacccaactcttcatatttgggaaaggccccacgtatgaaccccacacgtccacacgtccagcagcgtgtggctggttcagtgtcaccgtggctgactcagcggctcacacacgcatctgggtgttgccgtggaggcatcttcaggtgtgattgacacccttgcgtacagtgcctcagcccctggacacggacggcccctcctctccactgaaggcgttaaggaaagaggctgtggtccccaggagaagtggactctgccccagtggcctaggcactcccggggcagcgtcaccctccctggtctccagcctgccccctccctgtggttgtgcacctgaagcccacagtcatcagccagtcattcagaatcgatggattgatctctctcttcatatgtaggtacctgtattctcccataggctctgcttccctagagagccctgactaacacacatagacccacccaagtaattctgagaccagaaaagcgaagaacggcacagattttaaattgatacattctagtttttctccaactgctaacacacatcttaattcttttctttttttccccttaaattctagggggaacttctaatcaaattttaaataaataaagcaaacaaactccttctaagaaataacacaggaagagtttttcaaactccaagctaccagatgtgctctgtgctcctcttgccccagcctgcagggtcccatgagaagccagctgcctgtctgagcctgcgtgttcagcatccccagagaagccagctgcctgtctgagcctctccctggagagctctgcactgcagacgccctgggagctagcaggacctctggatcctgacagcagaatttctgcacaggtgtaggtaaggctgagaatggggcccttcctcagagggactgcaatgttgaggttgacagcccaggctcatgggatccagtggttcagggacacctgccaacctcatttctttcttcccccgaaactcacacaggtttctggccacaggcgacagagtgagacactagggaacattctctcaagtctgctgggagctcccaacttccaactctgtagcacccactcttcttcacagcagatgagcagttaaggaaactaaggggtaaaccccaggaccacagataaaccccaggaacccatggagtaactccctaggaaccaccgagtgaaccatggagtaaaactcaggaaccacggagtaaacccccaggaaccacggagtaaaactcaggaaccacggagtaaacccccaggaaccatggagtaaactctcaggaaccacggagtaaacccctccccccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacatccaggaaccacagagtaaactcccaggaaccacagagtaacccctccccccaggaaccacagagttaaacccccgggaaccatggagtaaacccccaggaaccacagagtaaacccccaggaaccagagttaaacccccaggaaccacagagtaaacccccaggaaccacagcataaatccccaagaaccatggagtaaacccccaggaccatggagtaaacatccaggaaccacagagtaaactcccaggaaccacagagtaacccctccccccaggaaccacagagttaagcccccgggaaccatggagtaaacccccaggaaccacagagtaaacccccaggaaacacagcataacctccccccaaaaaccacagagtaaaccccgaggaaccatggagtaaagccccaggaaccagagtaatctccccaggaaccacagaggtaaacccccagaaaccacagcataaatccccaagaaccacagagtaaacccccaggaaccatggagcaaacccccaggaaccacagcataaatccccaagaaccaaggagtaaacccccaggaaccacggagtaaacccccaggaaacatggagtaaccccccccccaggaaccacagagttacaccgccagaaaccacagagttaaaccccaaagaaccacggagtaaacccccaggaaccacagaacaaacccctaggagccacgaagtaaacccccagtaaccacagagttaaaccctcaggaatcacagagtaaccacccaggaaccacggaataaatacccctggaaccatggagtaaactcccaggaaccacggagtaaacaccccaggaaccatggagtaaaccccccaggaccacaaagtaaacccccaggaacatggagtaaaccgccaggaaccatggaataaacccccaggaaccacagagtaaaccctgggaccacggggttaaccactgaatgacagggcccccctagggacaagccctgcccacgagtaatctcacaggggaagggagggcatgtttcttagtaacggggcaggaactcatcttctgctgtgatgccacgtcctcccctgcacttcatgcctggcaaagctgctgggtgcaaggaaggtgatctctttaaattgtcctttttattaactgctcaaaacctcccccaccaagtcactgttccccatcccccactgtctcaagtgggagtattttctgctgctaacgacttccatggaacaccctgaatattttctctccatctctgtggaagcagggcccctcctccattgttcttctgaggagcacatgagcctcatctgatttgccatctctgaaatccaattatcagcgtgcgtatattaagctcccacacatgctggcctggcacaaaggctggctgggccatctgagggccccaggcctccccagaggaagaggggaacatccaccctttgcgtaaacccagagccccagggtggatgaggatggagcaccatggggatgaagtggatctgcccctgtgccccccacgtcccgtaagcccgcgtgtgacggggaggaccaccccccacatcccgtaagccctcctgtgatagggaggaccgccccccacatcccgtaagcctgcgtgtgacggggaggactaccccccacatcccataagcccacgtgtgacagggaggaccacccccacatcccgtaagcctgcgtgtgacggggaggaccgccccccacatcccgtaagcctgcgtgtgacagggaggaccaccccccacatcccgtaagcccacgtgtgacagggaggaccacccccacatcccgtaagcctgcgtgtgacggggaggactaccccccacatcccgtaagcctgcgtgtgacagggaggaccaccctccacatcccataagcccgcgtgtgacggggaggaccacccccacatcccgtaagcctgcgtgtgacggggaggaccaccccccacatcccgtaagcccacgtgtgacagggaggaccacccccacatcccgtaagccctcgtgtgacggggaggaccgccccccacatcccgtaagcctgcgtgtgacagggaggaccaccctccacatcccgtaagcctgcgtgtgacgggaaggaccacccccacatcttacacctccgtggggctcacaggcagggaggacacacctgcctgagggagtcaccagcccctccctccacaaagcctcactgtctccaaggtcccaagtcagaatgcaaacttggagaagccgggcccctcacagccagagcttcagacagccgggccccagcaccagggcggcccaaaccagccctggagccagagaagaggaaggggctgatggaaccacgtgttgtctctcctctggggccctgaggggcagcggctgaggttgaggatggaagacagcatgggccaccgaggctatgctctgggctgcacgttcttggcacccatgcgattccaagtctgtgtctgtgtagagccgcttggggagcacctgcaggcccagcgtccctggagatacctctgcccctgcgggcctcctccttctacccctgcgggcctccagttctgggcttggcaaacttcccacgggagaccaggaggccagagagaagcccccaggacagggctgtggccctgggggcacggtccctgccatgatggggacgtccctggggcaggggcaggaggcttggggaaggatgaagctgcctgtggcaccaagcagacgcgcctgcctgcaggagtgaccactgcagggtcgctggcaaaagctcccgccatctgaccctggggaccacatcttcccccgtcacagaaatggaaaagatgtttccaggccagacctccagcaggggccttgtgttcccagggagcagggccccagctttatattcgaagtgagaggggagactgaggtatgaggtgcagggatccctccacgaggagatgttgtcaggccctggtcatctccactgagcccaacagctgctgtgtcccgggcatggctgaaggtggctgacccaagcaggccctgaacgcgagggacccccagcagccccacaggcccctggaccccagggacccccagacgcaccatctccatgagtgctggttcctgctccctcctcggggtccctggtgcaggtccccaggtgagctgagaaggtcgtggctctcgggccccgctcaaacctgagccctctctgtcctggacgtgagggcagagtgtgcacaggcctcccccggatgtccctctaaggaagatcttttcctgacaacgtcatgtgtcgggagagggtcctcttgtggaatatctgaagacctgtgtcatgtgtgacttcaaaactcacgactccccacgttcaccctgcccttccccgcacagaaacacatcacggtgcctgctttaatctgcagcttcatcgggctgggcctgacacagctctctctgcagaggctgctgttaactcacgcaaaaggacctgccagtcagccgggcatgtgggcagtgcctcccacccagaaaggaagcccacgtttatcaggaccagggttctcaactgtgtccccgggggcacacggcacgtccaggcaggagacacgggacacgtccggagagtttgggttgtcacaccggcggctctgatatgccgcaggcagaggccagggcccaccagcaccctcagcacctagggtgccccagcacagcggttggccagccctgaatgcctacagtgccgaggtaagaaacgtggcccggtctgtttcacccatggccacagcacagagcttcatggcacagaaggcggtcatgcccaggagtggaaatcggacaggcaggcaggggccactgtcctgctcgccccccaccatggcctctccctccgtcatctccaaggtcaatagcatcatgtcaggatgaaccctatgatgtctccacgtctgcgggtaaaatggggttggattttggcagatccatatggctccacctaaataacctggccatgcccacaggatgtccaccagcagacaaacgcaggagcctccaccactgcagcggggagctgcccaggcctgtgcggggccagccccggggtcagaagagccagctgccggcagagcatggtggcgggtcaccagggccacctggcgcggtccccggccatacttgcagggaggttgtgccctgacggcagggttgtcactgccccccacctcccatccctaatccagaaggtgaggcggctgcaagacctcatcccctccgaccccagccccatcctgtccatcccactgcctgtgaccagcgcgtccaactccagcaggtgatgctggccctacctgaaggggcagagggtaggacgagcaggtcgggacgggctcgggcgtcaggcggaagcctgcgtaggccaggatctgctgggcggggttgtagagggtctgtggtgggacggctgggccataggccagctgggacagaggcacctgccatggagaggagacgggtggtcggcgtgtaccccctagtggagggaagggctgtccagccttcctagaaagcccagcaccctcgacccccgactctcaggctggaactaaccccggcccggcgtgcgtttatacccaggctggagctaacgccggcccggcgtgcgtttatacccaggctggagctaaccccggcccggcgtgcgtttatacccaggctggagctaaccccggcccggcgtgcgtttatacccaggctggagctaaccccggcccggcgtgcgtttatacccaggctggagctaaccccggcccggcgtagctttacactgaggttctctacatcttggtcccagggccccgccacctgctagtcacactgggtgaccgctcggctcgggctctcttttacttttttgattttttggggggggagaaaaaagcactggtttccttctctccgggccccaaagtctgctttttcggcacagaagggtgcaggtggggagggccctctcagcaccgggctgatggctctcgcttccccaagcctgtgccccaaccagcgtggggtttctggggaatgcgaacaaaaccaaagtctcctgagctcccgtccacactttcactgactcactcaggcagttaaaattctccaaagaaggtgctggctccaactcaggccccggccggcctcatcccctacagagggaggggcccatggctcacacaagcttcagggcttccccgggccagaaacgcggggactgggccgagggcacccgggcttcgcctccctccccaccttcacacaggtgcccctccaccttccccagcccccacccccaggttcagcagcaccctggaggaagccaggggaagatggcaaaggcggggaagccaggccagagccgctgcgaggggctggccacggtgacgacccggggacacggtgacaacccggggacacggtgaaaaccccgggacagggtgatgaccccaggcctgaggtgtcctcagacaacggtgctgcccgcacccctggggctgggagggagccccctgcccagcgggcactggaaggtgggaaggggcagggccttctgggcagctggtccttggtccacatgtgcaggaggccgtgcttctgcctcagaccctgcagagagcaggggggcagccgaggtgggcctgggaggttggatgggcatggagggtcgtgctccgtgagggaggggcaggagatttgcagttctgacaggtagaggggtggggaggcctctgagctggcggtggcctgaggatggggccggggcgagtgcacagaaagcagagaacacgggggccacggagtcacacgcggaggaggcccctgagaggctggctcagccgcccgcccttgccggcacgttaagtgcctcccacgcacccatcacaagtaatttgccctcgtctacgaagggcacgtccagcttggaatgttaaggaatgaaggaagcatcttcattccttaacaaaatgtttaaatggcaaaatcagttaaactcacaagagggcctgcttggtgggtgtgaaggttagcaagtcctctccttgctctgcagccctgagctttgggttcgaggaagacttcctggagccggtgtggctctgcattgcgggctggccctggaggtatcacctgttcctgatcctgcactccagcattttatcacgggctttaatgaacacacgagccccttccggaaaaccctggacaccccgggcctgtgtggcgagcatggcgcctgcaccagacaagcgtttctgtgtcctgtctacaatccggctgcagttcctcctgggacggccgctgagaggagacactgagctgccgaggcagagaagcttgcaccgaggagacgccaaaggcgcccggagcccgcgagatcccggcagagacccttcccgaccccagactcccgctcccaccgcaggggccggccggctgtcaccacagagcaaggacccctgggaggtgcctgtcttgtgttggtgtgcgggcgtctgggggcccagggtggggcttggggggccactgggtggggagccagagggctggacctcgggatgccagggtcactctcagcttcaccagttttgtctggaagcacaaaagtgttgagaaaaggaggagctgagaagcagatggcaggagggttcccagctgagctaatttttagtcatggacagcctctgggacgaatagggcatggagaagccgctcaggagtgttttcgctgcctcgctgggccgggtctggcctgcatgatgtgcgtctgcctggtgctgccaggcctcctcatgtgggtgcaagagggggcgcccctcgtccctgggctgccgtttggatactctgggggttggggctccctcactcctggctgcccatcccttacagcttctctgcaagttcagggggcggggtttgctggccgcacaccacgagaacatctggtttgaaacaggcgccaggagagggcagaggagggagaagagagaggacatccggcccgggccagtgatttccctgtggtttcccgggcgagggccggcctttccaggatgggtccagcccacctcccgcgaggggccccttccctccctcctcctgcccaggccaatcctggctgtatgggtctcgcctctggggtttgctaaggcatcagctcagccccagcccagacctgcccatctgaagccccaggcagttgctaatgatgggagcttagtgcacaagggctgggcctccctcttggagctgaacattgtttcttggggacggctgtgcccacctcagcggggaggcaaggattaaatcaggtgattcttgtgacaggcttgggacaggacggccccgaggtgagtcggtgcacgccagctgtcaccctgacaccctgctgacagacgcatgggcttcagtgccccatctgtaaagtgagggctggaggccccccagcccaccccggggaaatggacccggagccccggctcccagtgagcagcgggggtcccaccaaggggcctcaccatgtccttgaaggcccccaggacggcggcggtgatgatgcccaggaacaggcccaggacgttcagaactgcagaggcccagagcaggcggtacaggtgcagcacgtcctggcagccgctgacgccgatgaactcatagtaggcgggcgagggctctgcgctgcacagagagggcaccatggcgtcaccgcacgaggcaagtgaccacccgcaagttaaacttgtgtcctctggacctgagccctgcagggctgggggaggaaatcagggctggagcccagtcaacgcccatccctgcactgctctgggagatcaaacctatgtctgatgggattggcctgtgaggctccccacctggggcccacagtggcaaagagcggcaactgggcctggcgggcccgcccctccgcctcgatggcctggcaggacgggtgtctgggccccggctgagccatctctgtcttcacgccaggatgggaaggccgtcggggtcacgggcccctgtcccaagagggggccatgcctggggcctcagaggccaggccaggtttaaactctcgcccgacacacacgggctgtgtcctcttgggcagatcaacatttcagagcctctgtcttttcatctgtgaaatggactcaatgtcctttcctcatgtaaacatctaaggagtaaaggagacgatgtaggtgcaggggtgtggggggggtgatgtcaggagcagaaggatggaggcctcacccctgcaggcacatacgggggttcccagcgcccctcacctccctcaggtgtagatataggggtccccagcgcccctcacctcccgcaggtgtagatacgggggtccccagcgcccctcacctcccgcaggtgtagatatgggggtccccggtgcccctcacctcccgcaggcatagaggtcacagcagtaacaggtgttgcttctcaccttcagctggcacttgccgtccagggagtgacaggtgacctggggcagagaggccttgtcaggtcacatgccggtgcccaccacctcacccaccccaccaagggcagggctgcctcatgggagctgggagcggccactgaggcccagccaagcagctgcctcccccgactttcccccgactccagacacagaggcttgggggctcgggggccaggacccttcctgcaggaggggtcaggggcacaggctggtcccagaggccggataatcggggctcagaggagaggccttgcttctccatgatcccaggagcagagggaaatatcagggtgcgtgggcagaaggacagagcccaggaggccttcggcgtggggtgcacagaagcctgagagcccggagggcggcagaacaggccccgtcccagggcgctctccccccaggcttgagcactggcagcctcagaagagacacctgccacctctgtgtgacaaccttgaaagccctggccaggggacaccccccaacacacacacacacacacacacacacacacacacacacacagaggacgcctcccctgacacacacacacaggacacctccacacacacacacacaggatgcctcccccccacatacacacatggcatgcctcccgcctacccccccccacacacacacacaggacacctccacacacacatacacatacacacacaggacacctcccccctaaacacacacgggacgcctcctgcctacccccccccacacacacacacataaacacacacacacacacgatgcctcccggcagctgctggagagtcccagacaagctggcaggtgctggccactgagagggcctccagctcctcctcctctgacacgcgtgctgaggatgagaggctgcgtttagttaaagccaggaatccacacagggcaggtgcgagacacacagagagcgccgtcacagagctgtgccctccgacggtcctggcgaaggcggcggccgcccgcgggtcattactccccgcatctcactcacctggaaagagaaatgaggtcacactgccgctgtcggtggctcagggaaatccagaagtttctcggacactgtaaatgtattatccttgcttcttattgcaataattaaattagaaaaatgctaattggaagagccatacagaactggacacgtgcactctgagactgttgtgatttaatgaagcaagtccagaactctgactccagagtgaaatacagcacatcgaaatgtcaaggtcccaaacacagggggcatcaacggttcaccagctgcaggggtgacccccaggaactattagaatcaaaatattcagaccacgcctatgtgcagggaaaaccgcgtggggtcggcggggttagctgagcaaaacccacatgaatctcagtgctcctgctcacctctgtctggtagacatcgtacaagtaccccaccccactggagtaaaactggcatcttcccgtggtgaggggcctcggttcctagagaaacagataaacacagatggaataaaacaggtgcctccaggcgggagaggccagaggcaatttcaggcctgtgggtctcaggctcagggcctcaaggaccaaggccaacaccaacttgagcctcccagacacagaacacaagatgggagactccacgctccctgcagagcagctgggctgctgcatccaggaggccagacagcagaaagccccatgggagggtacctcgggccatgcatattctccatcagtcaacaagggcagcagaagggagacaggtgcttggccttttgaggggcatccctaccaccccacatcacaggtgttaggctcctgcatcgtttcataaaagaaaatattgtctcttctactaggaaggtagcaagaaggatttcagaccaataaactcatccctccaaccatccaatcatccacccacccacccaaccatccatccaatcatccaatcaatcatctgtgcatccacccattcttccttccatcctctacatctatctattcattcatccataatgcatccatcatccatccttccattcatccacatccatccatccacccatctgtcatccatacttcatccatccatccatccatccatgtatccatccatccttccatccatccacccatcatccatccattatccatccttccattcatccacatccatccatccacccatctgtcatccatccttccatccatccatccatcatccattatccctccttctatgtatccatccatcatccatccttctatccatccacatccatcatccatccttccattcatccacatccatccatccaaccatcatccaaccatccatccatcatccatccattatccatccttcgattcatccacatccacccatccattcatctgtcatccatccttttgtccatccatcatccatcatccatccattatccatccttctattcatccacatccatccattcacccatctgtcatccatacttccatccttccatctgtccaccatccatccatcatccgttatccatcctcctatctatccatccatcatccatccttctatccatccacatccatcacccatccttccattcatccacatccatccatccatccatcatccatccttctatccatccatccatcatccatacttccattcatccacatccacccatccatccattcctgtcatccacccattatccatccttctatccatccatccaaccattcagccatacacccatttgtggccctatccaactatcaatccatccgaccatctgcaacattcatggagcagacacagtgccaaatggtaaggataacgagacacagttcttgcccttaagggatttatagactagtgaagaagacagacccataaactgaccattgcaaagtgcttataattgctatggtagaggacagcaggaagtaccaaaactaaaatgccacaaaactgcatcacctgcaaataagctagggtcacattgcccacgtttagttttattagtatttctcaaaggctcctagttctgaaccaagaaaagtattagaaaccactagtaacactgcaacagatgagaatgagaatcactcatcggtcctttgggcccccactggtgaagtactattatggccggatgcgttctaggtgacacagcaatggaggaagcagacacaagtctctgtctctgggtgtttatcttcccctgaggggacagacatgagaccacaggtaacaatgagtagcccaaggggacagaggctccttcctggagagagggcagtgcaccccaaccccacggacagaggctcctgctgggagggagggcggtgtgccggaaccccatggggacagaggcctagcagcacggtgtcctcggcctctctcaacagttggaaggcacgcatctccccatatgacgcccttagagctgtaattcaccatctgtcttcttcctcagcagcacacgaggcagtgccacattttcctcgatggcatctgagctccagtgagtgctgtctgcgcatccgtcctaaagtcagccctgggaggccccggccaggggccctgctttgtttctaaccaagaggctcccacacttgcctagatgcatgccccgcgtggccctccagaatggacaggcgcccgaggtccggaacctggggacacccccgactgcggtcagagactggaccctgctcctcggcggggccacggccacgggcgcctggagcacagtggaaaccaccgtctggaagccatagaatagcaagtcacccagccacccgctgagaaagctcccatgacgcacctccgtgggagtgtgtgtgtgcgcgcgagtgtgagcatgtgggccgtggtgtgtgcatgcgtgcgcacgcacgtgtgttttgtgaatgtgctcccacacttgccttcatataatgaaaccgttggggcagacaaaggcctaacaccaaccttcagtgcctttcagtgtgatttatggaaaaagagggagaaacaatcacaggtttggtctgagagttcatgacaagcaattcggctgctcccggggaccagctgacgcccagatggcgagagcccacccaggagcccagccagggaggaggggggatggcgcagcccaccggaggctgaggacgcacctcaggaggacacagaaacgattccttggcctgcgactttagagaaaacctgttcatttagaggtgaaaagagcgtggtgtggtgtgtatgtgtgtgtggtgtgtgctctgtgtggtgtgtgtgctgtgtgctctgtgtggtgtgtgtagtgtgtgtggtgtgtgctctctgtggtgtgtgtggtgtgtactctgtgtggtgtgtgctctgtgtggtgtgtgctctgtgtggtgtgtgaggtgtgtgctctgtgtggtgtgaggtgtgtactctgtgtggtgtgaggtgtgtactctgtgtggtatgtgctctgtgtggtgtgtgaggtgtgtactctgtgtggtgtgtgaggcgtgtgctctgtgtggtgtgtgaggtgtgtactctgtggtgtgtgctatgtgctctgttgtgtgtgtgctgtgtgctctgtgtgttgtgtgctgtgtgctctgtgtgttgtgtggtgtgtgctatgtgctctgttgtgtgtgtgctgtgtgctctgtgtgttgtgtgctgtgtgctctgtgtgttgtgtggtgtgtgctgtgtgctctgttgtgtgtgtgctgtgtgctctgtgtgttgtgtgctgtgtgctctgttatggtgtgtgtgctgtgtgctctgtgtgttgtgtgctgtgtgctctgttgtgtgtgtgctgtgtgctctgttgtgtatgtgctgtgtgctctgtgtgttgtgtggtgtgtgctgtgtgctgtgttgtgtgtgtgctgtgtgctctgtgtgttgtgtgctgtgtactcttatggtgtgtgtgctgtgtgctctgtgtgttgtgtggtgtgtgctatgtgctctgttttggtgtgtgtgctgtgtgctctgttgtgtgtgtgctgtgtgctctgttgtgtgtgtgctgtgtgctctgtgtgttgtgtggtgtgtgctatgtgctctgttttggtgtgtgtgctgtgtgctctgtgtgttgtgtgctgtgtgctctgttgtgtgtgtgctgtgtgctctgtgtgttgtgtggtgtgtggtgtgtgctgtgtgctctgttgtggtgtgtgtgctgtgtgctctgtgtgttgtgtggtgtgtgctgtgttgtgtgtgtgctgtgtgctctgtgtgttgtgtgctgtgtgctctgttgtggtgtgtgtgctctgtgctctgttgtggtgtgtgctgtgtgctctgtgtgttgtgtggtgtgtgtagtctgtgtggagagggaagttcgttgtgtaggaaatgagacttactgagaggagagacagtcactggcaacccccagcgtggagactgacggtgaagccgtctgagctgagatctgcaaaatgaaattgtacttttttcacgtcgactctttcagccccggaaagcgactgtgcacacaatgacaatgtactcacaatgtgctgtgctgcaaatacgccgtccacgatggcgcagcagaaggcggccaccacgccaaaactgataaacacgatcgctgccaccagctgcaacagaaggagaggtgtgggtgcccagcttttaccaaccccggttttcaaacgcaaaccaattcaaagtcccagctcgaggtcggggcttctttcacagaactgcctcttctcacctctacctttcgtcctatgacttccagccctggccaggccggactccaccctgcgggtcgtcctcacgcgtctattccgcaagacccacccaggcgccttctgcacggaagggcgttgccatccccgggccctcggcacgcgcctctgagaagcaaccccagacggcagggcgtgtgcccaaccctaatgtgtgctcatcacacgcacacacatgtgcatgcttgacacaggcctttacagtcatcggatcagcttcacacactgtcgcacaacctgcttttcctacctaatggtcttggagcttggagccaggaatggtttatagtgcgttagttaaccagtgcactctgatggatagttaaacagttggcaatttcttgccactacaaactctgctataaagcggggtgtcctgccctaaccctaaaaactagcagggagtctccatccccgtggacccctgaccagagggcgggtgctgtcattcttttctcggtgcctggcttggtaccacgctgggcagagcagaccctcctgaatggccgctgaaaactgtggccccgagttggcatctcgcttggttccgtcccgatggatgagttgtcggctcgggaaagaggtcccagtgacaagcagaacccatcggtaacagcagagggagggcctgtggctcgggcacatggtgctacacagggacaggggaagcctgagtctgttcggacctgtcctgcgcaccaggcacgagcgtgggtgctcgtccagactcagagcagagccgaccgagcagagtggtctcctcctcacacttgcaaagacgcccggcagaggcaccccgaccttccttctccctggggagccaagtatgtggagagaggagttccatcgaccgtgaccctcacgtggaactgctgtggcctcttcccccgatgtcagcatggccctgtgtgtccatctctgccccaggctgcacacctatcgtcacccgcaacccaaagagaagccaaatccagcccatctgccaaggctctaacgctacccgctggattcgcaggtgggacgcattcccatcaggccccacagcagcagaaggcggggggtgggggctggcgggcccaaacctttcaggccatggaccagtggtggccgcctgcccctccctctccttctgaccctccacaccacaggcccgctgggggtcctccctggaagccccatcagagccggtccagggcgcaccacgctgctggccaagcccttttgcggaggaaagtgcagcttcttttttaaacagtgggcaccctcactgcgagtctgggtgtttttatccttcagcagaggaagagctgtcaactgggggcttcctggtgagcccacgcttggcagtcaccgatgccaccttgcattaaatgtgagtgatgaggcggtagggctggggcagcgggccggagagcgagtccacagaagtcagtgcgtccttgggtgggtcccagaccggcacggtccctgcgtgagtcacagagagatggttctcccacctgctggcacctttcttctcaggtgggtcccagaccggcacggtccctgcgtgagttacagagagatggttctcccacctgctggcaccttcttctaaggcaactttcctccacagcagatcagacgagacattctgagagctcagacatcaagcacgtgcccttccaaaatacatactttaggtttacgagaagaggtaggtctgaacaaagtccgggcagttagcaggaagctggccgacacccctgagctctgtctcccagtggctgtgcgagggggcagagggggacgtggccaccagacccaagggcagcacaagggttctcggggtggccttggaccggagcccttaccctcgcatcccccctccacctccccaggcagagcagagcagagctggcaagctgagtccttccagagcgttctctgaactgctgggctggacttgcccctagtggtccttggttccccctctggaaagggaggtgctgggttcactgacttattcatgagtgtcacggacgctccagcgtccccacgggatacgcagcctggtgctgcaggcgcagacatgagcaaaacaggcacctccccgcccttcccgcgtctcacgtttctggcattttatcatcgattgcctaaaagaaagttgagatgctcccagaagaaagctgtgcagaaaaccatggctgcattagcctgggtctgaaccaaaagcttacttctatttggactttctacaggctgtggcaatttaaaaatctcctcttctgcctaattgctctggttcgactgactaaataatgacggagcccatcgcatggtgtagctgcccagtgtgctggaggaacagacagatgagggaggttccctcttgaacagctgaccccgtctgacggccaccatagcaaagcataagccagggctctgggtgcacacacaaggaaggcctcattgcaccctgagaaagaaggaaggcctgaacgagtcctggaagaataaacagaatttcctcaaggggagacagggaaggtgctgggggctgcacgtcggtgggactggggcccactgaggtggggcagaggccacgatgtgcagggctaggggtgagctgcagccaccatgttacggtcagaaggtcgtcaatgccaaggttgtgtggccgaaggcaagagacttccttcaccttcctattttcctgatgaaactgctgcataaaagtaaaatgactattatgcagagctgtgtaaaaacagcgggcagaaattacacctaactgaaatttcctacattcagttaggtataaatacgtaaaatacattaaaaatgtaattgtttgaacaaatacataaaaacacacacagacggctcagagggcaacatttgaggtttcccagtcggggccaagcccctccaccttcccagaggaagatgaaagccggcctccagcggggccgcgtccccagctctggggcctcccgcagttccgggggatgttcctgtcccgcagtgcacccttctcgtgggtgccggcctggatcagggggctgcgtgcctcgctctagcattgcagggagagcggcgtcacatcccatcatgcctgcagacatgcttccagcattagatgcaagcacgcagaggggccgtggtcccgtcaccactgcacacgctccttaagaactcccacagtttctgttgggcacaattcccaaccaaagaggcagaaggaaaaaagacttaaagatgaagaaaatcactttaaagcttccaaagttctttcgctcgacccatccttctaatccgcacaactgtgacatcatcatcacaatttgcattttgcaggtgcggctctaaggacttggggctctaaacatctttcgctcagacagcgcctcagctcaggagcacaagcaccccttccctgctcctggttgagtcaccaccctcagagccactggtgtccccaaggggacatctgtccacacgacgtcgctcccacagatccctgaggggtgtgtgaccagtgtggtcccccagattcgttggggctgcccaacgttaggaagcccacatctgcctagtgggagccgaagccatcccaggaggatccagcgtccctgtccggctcggcggccggcaggtgccacccgctagatgccccggccactttcagaagtgggtggcaggtgactcatccaggctctgctgggtctctcaccgtaaatgcgtgcagcagagactctgccaggatgtgctggccctagatgttcaccttccaacccagtaacccctcatgaatgccatggagccaggaacctgctgcaacccagccctgggcaggacacaggcccagaccgttgagaggtgttcatatttcacccccacccaatttcacccaaaacatcacagaagcaccgaattgttagagcatccctaaaaattgcagggtctaccttccatcacccatgtttcataaacacattcaaacttggtcatgcataacacttcccaccctgcgaacgtcctcgcagatgtcccagctctgcctggctgtccttcctcccgctctttcagtgtgaaaggtaaaattcagcgagagtgtggccacgcgcagcaagttcagtgctaggatgtctacgtgtccggtcagtccagagctaggatatccatgtgtccagtcagttcaatgctaggatgtctacgtgtccggtcagtccagagctaggatgtccatgtgtctagtcagttcagtgctaggatgtccacgtgtccggtcagtccacagctaggatgtccatgtgtccagtcagttcagtgctaggatgtccacgtgtccggtcagtccacagctaggatatccatgtgtccagtcagttcagtgctaggatgtctacgtgtccggtcagtccagagctaggatgtccatgtgtccagtcagttcagtgctaggatgtccacgtgtccggtcagtccacagctaggatgtccatgtgtccagtcagttcagtgctaggatgtctacgtgtccggtcagtccacagctaggatgtccatgtgtccagtcagttcagtgctaggatgtccacgtgtccggtcagtccacagctaggatgtccatgtgtccagtcagttcagtgctaggatgtctatgtgtccggtcagtccacagctaggatgtccatgtgtccagtcagttcagtgctaggatgtccacgtgtctggtcagttcagtgttaggatgcccacgtgcccggtcagtccagcgctaggatgtccacatgcccggtcagttcagtgttaggatgtccacgtgtctggtcagttcagtgttaggatgtccatgtgcccggtcagtccagcactaggatgtccatgtgcccggtcagtccagcactaggatgtccatgtgcccagtgaatccagcactaggatgtccacgtgcccagtcagtccagcgctaggatgttcaggtgcccagtcagtccagtgctaggatgtccacgtgcccagtcagtccagcgctaggatgtccacatgcccggtcagttcagtgttaggatgtccacgtgcctgttcagttcagcactaggacatccacgtacatggtcagtccagtgctaggatgttcacgtgcccagtcagtccagggctaggatgtccatgtacacggtcagttcagcattaggatgtctatgtacacggtcagtccagggctaggatgtccacatgcccggtcagtccagggctaggatgtccatgtacatggtcagttcagtgttaggatgtccatgtgcctggtcagtcagcactaggacagccagaaacatgaaaatgccaagagcttctcatggtgcttcaacccgagtccaggcagtggtgttgggaaagacattgggaatggcctcctccagctcctctggctaagtccgaaagtcattgccagaaccagcctcacgagagctgcctcagggaacagcccacatccccctggactgcctggctctgtcacgacttttctccaggcattgttaactcttgttcagataaattttttgtgacctagaacgtgcatagcaggaaccagatcaattctccaaagacacaagcaacccactctccatagcccatgaggactgcgcatgtctacggccactgccaggagaaactctgtccctgcactggagccacaaggatctggactgaaggctgtgaagatctcattgcattctgttggggcatcttctcttgagcaaaggtcaccttcaaatgcctctgctctcagagtttacattccaacagaagaaagtagatttacaaaaaaaaaaaaaccacactgagcataaggtcatggtgatcagaggaaaagaaggaaggggataaggtggggagggagagtggcccgggtgcagctacctcaagagggcggctgggtctctgtggtctgggacattcgagcagagactcaacaaggtggagaccctgcccaggccacccagcagcacctgcaaaggccccacagcatggcatgtgggtctaaggagcaccagggcagtcggtcggtggcctccacgaggcaggatgagtggggcaggagggagggagggaggcgcggcgcggcccccgggtgcagtggtcagtgggaggggagccagcttccctggggtttcccagaactctggctggggtgagggcagcggcagggcccaggcaggaggtgacggcgatggtgagggccagaagcgcgagtggagtacacaggtcgagtgtgcagagacaaacgggtggagggcggccacacggtgacaccgtgctgatgacggcacagagccagggcccggatgggcaagagcagccacttccatctcacaggtctgttatcacccacacgatgacggctaagatggctgtgtacgccataaatccagcactaggatggccacgtgtggcaggaggagacacagggagccaccagccgagggcagagaggagcctctgctgcgccagtgccaggccacgcaggcagtgcaacccctgagcccccacccaggccagcagctccacctgcgagaggcacctgatgcagcctctgctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccaccccctccgccttcccctctgcccatccccactccctccgccttcccctctgcggcatggtgcccctggccgacacctggagctgcccatcccgtcttaaccacagatgtcttctcaacacctcctccccgtccatgccctctcctccgcctcgcttcctttagagtaaacctcctggagagagtggacggcacctgcagctggttcctccttcctgggtcaccaagcccaaatctgcccctcccaaggtcaccatgccctgcctgccatcaatccaggggtcaccctcagccccagctgacgcgattcaccatgagcatttgacacattcacggctctcacactcccctccccactgctttcccaggcacaacctaattcacttcacaagcaggtccctgctcacagttctaagccatgtacaatttcagctcattaacaatttcctctccagcttcccttcttcacgtctgacctgcacacctgccatgcgggtgtcccagaaccacaaaactcaggggctccccacatggtcgccactgtctacaccctacactcgcaccatccacaccctccaaagaccctgaactttgacctgctcatttcacctatcatcggtttctgtgagcaaacggagaagagaagccgcaccactcaggtcagcaacaggcagcctctgtccttttaagccttccccacacactgaagaaattcttagaacgtttaaaaactgttttccaacttaaaccaatcaggcattattttagtctagaatacatgtttttcaaatgctaataaataagtgataaaggagagcaaccaaattaaaatccagaccgttggctctgggagatgcccaatgtagctcttccgaaaacacccctgcgcgtgcacgtggctgactgtggagctagcaggtttgcacaaggcctactgtaagttttctctattagagacaaaattttaaaattatttaattatgacatattttcacatgttctgttcattaaagtgtcagagtccaggtatgaaacaacgaacaactagaacctctcagaagtgccttacggggcccattgccaggagtaatgtggtctcctgtgtgaaggcatgccccatgcatgtcacatgtgtaactagtgagcctggaacagggctcactcctcctcaaaaaccaagacgtggcctccttctcagtgaatgagaggccactacagatgatctccaacgccaccagcccagaccgagaaatgagaaatccatcgtaatggtttcttctgatgactcgtctgcaatcccttttcctgcctgctctctgacgtggatgccagggaggaaattcactccccagcagagaggaagcagctgctgctagtgacgacagtgatgacggtgatggtgatgacagtgatgatggtgatgagggtaacgacagtgatgatggtgatgatggtgacaacagtgacgacggtgatggtgacaacagtgatgatggtgatgatgatggtgatgacggtgatgatgttgacgatggtgacaatggtgatgacagtggtgacaatggtgatgatggtgatggtgatgatggtgacaacagtgatggtgatgacactgatgatggtgatggtgatgacaacagtgatgatggtgacgagggtgatgacagtgatgacagtggggatggtgacgatggtgacggtgatgacagtgaagacggtaattacagtgacgacagtgatggtgatggggatggtgatgacagtggggaaggtgacaatggcaatgacagcgaggatggtgacaatggtgatgacagtgatgacaggatggtgatgatggcaatgacagtgatgacagtagggatggtgacgatggtgacaatggtgacagcggggatagtaaagactgtgatgacagtggggatggtgatgatggtggcccatggttctctggctagaatcccgaagtccagagccctcacggtttgatgcttgaattcattttacagcaaagcatgccctggtctgaagaagtccatgcacagcctgcatttaccccacgttgtgtgaatgttcgtgtgctttgctttggaaacacgaagtgggagactgcctcagactccactggaggaatcaaacggtctggcccatccccacgttccctcctaaaatccaaaacactccgagaagcatctggctccgggagtgtccgagaagacacagggatgtgtgagtacgtcaagccactatcccaggtgtttttcctgcctctcctgagcccctgagggcaaccctatcatcccttcatcgagaagaggacagggaggcctggggacgtccagcacccacagtcacgtccagagtggggtctccaagcccagcggcaaccgttcctacttctgaccctgaccaatgacctaagggtttcaaaaccagggaaagctcatgttggggagactgaatttctaaatttctgctgacttagaagtttctttaattgaacttttcagctttccagcctctctcctccggtgggtctatttctctgtcagtggtctaagacctctctttgctcatgcatttgctaaagacaacagcaagagaggtaggacgaggagcaaacatgagaccctagtgccagctgagtcagaaaccgcagctgggggtgagggaagcccgcaagcctccctctctgccctgcagtgttttgcctggagggcaacctctgtcatggtattagaagtgcaggtggaaatcagaaggcaaagccagtgcctgcgtgcagggcagtgaacttcaggaaatgactctcagcctgggcactttgccagtgacagagcaggggcatcaccatcttggacaaacactgccattttaagttccctttgactaaaaactgcctaaatccagccccagaaacatcaacttactgactaatgtcagcatgaccataaaccacaaatgacacctccgaccagaaacattccaaccctgcaataaaactctcctccacccagaaacattctgctcctgcaataagctccccgcttcataaacccttaaatacccttatataagagagaacactcctgacctaaattcaccagaagcccctctcaggtttattctccaaaataaacctctctttgatggttgagccacttttcatgtttctttcctctttaactcttacatttggtgccgaaacctaggacaggtgttggggccagaggctctcttgcaacccaggaagccgtgggcagtggcagctcgtcccaggctaattcctagatcctgagggcctctagccacctgccttgtcttttctctcactttactttctgagcaatttgcataaggaggacaactgacccgaagggaactgtgaggcttgggccggggctactccccagtgggctctcaaaatcctcaggtctcagaaatccacctccaaccgctcacaatgggcatttcactctctaacccttctctccttctcctccttctcctcctcccttctcctccttcttcttcttcttcttcctcttcatatccttctctctctctctctctgtcttcctcacgtggctccagtctgggaggcgctttgccaattccaactggaacatccaacaccagacacaaatccagctgactggtaagatctgccctcccctggctttctcatggtacccaggaaagtcagatctgccgtcctggtcctcagaggaccagtgggattaagctggggaaaatcttgggaactcccagtctcttctcaggttaattgtcctctttataaacaggaatctgggtctctgtctttcttctggagacacctagaacaaaaacagacaccctcggcctcctcttaccagctcacatgggtgcccaacaatcccacatccctacaccctccccgctcggctgtctccttcacaacctcaccaaacttggcttacaggggagcctaaagccaaagcgtttagttttttatggtaacacggcctggcccaattcaaactagataacgacagccaatggcccaaaaacagcatctttgactttcaaattctcagggaccttgacaactttataaccaggagcagcaaatgacaagaggttccctatattcaggcctgcctatgtcatgcttgcacccctcatgaaatccttcttcttaaagaaaaccctccccaggtcttcccttcctccgaaatcccttcctccgaaaccccttctgaccctgcagatgaaccccctctgtactctcaaccctctgcatctgctcctcacccgaccaaaccctccaccctgttggcccctcctacccccaagcctttagccccaaacctcacccatcctccttctccaccagtcacccattcagaaactaccccagccagtcaagccacctctgccattctccctctccaggaagtagctggggttgaaggcactgcttgcgttcatggccctttctccacgtctgattttctccacgtctgacttgtcacagatccaacagcacctggaatctttctctgaaaatccctctcattatcacagggaattcctgcacatagcccaatcctttactttaacttggcatgacattgacataattctaactccaccctcactcctgatgaaaaggagcatatggcattcagctgaggccgacgcagataaactccataatcaaaccctgatataaaacccagtggctaacgatgcaggccccgtagagatccagattggacttaccaacagggagacactggcttcaggcaaagaaaccacgtgatcacctgtcccctcgcaggcatggacaaaaatgcccataaggcagttaattatgaaaaactcagagaaattacataagagccccaggaaaatcctgcccttttcttaccacacctcactgaagcgatgctaaaatataccaatttggacccagaatctagagaaggtcaaacttttctccccctccaatttgtttcccaatccaccaagatatccagaaaaaattataaaaattagaggagggtccccagacatctcagtgggacctcctaaatgcagccttccatgtctttaacaacacaaacgaggaacaaagaattcaaaaagacaaacatctccatataaataccagatgctcacctctgctgtccaaaagtcagctccacaaaaagcctcctgataacccgaaagaaaagtcccccacctctgggagtctgtttctgatgtggcaacgctggacactgggcaaaagcttgtcctaaacccctgcccccaccaaactgtgcccaacctgtggtctctggggacactggaaaatggacggctcccaacagggacaccttccccgttcaggtggggctcataatgaagcccccccctccgaccatcacaggaggaaatctcatcgctgccggcactgacaacggaggactgagggtgcccggatcctgcgcccccatgtccagtgagtccacggaacccagggtaactgggacggtatccggtaggccagaagcaagatggagtcagttcagaccgttttcactgtctcagtcataattgtgcaatggcagtttcataactttaaatgattaccacagttttcataaatgatctaggcaagtgattaaaataattagataaatgtaatgggacaaatatttgtaaacaaacttgtcatcatttggaatctaaagttatattaaattaaactacagctatttcattatttaggtttttccaataaaaatatattgtaggaaagcattctttctaaaacttgtatcctttttaaaggttaaataatttgtgtctaattcaaagcttatttaaaggttttatataaaacaaggtaaaagaaaccaggaaataagagagatataaagaaagttacaaaactaaaaagttgtaaagactgttgctaaaataaaaatatcttcaaaaatgtaaacagttggtctaaattatgcaggtcaaatattaggtttattaaatgcttttagatcataaactggttctttgacttaaaaattgttcaatttattttggagtgttaaattctagataaggcctggggatataagaaattagccatgccccctagctatgcaaaaaggtattaaagaaaagaatatttatataagaaaggatcttgtatgataaatttttgtcctgaagtaaaataactggttgtttgaagacagggatgtttaggacaagtcagaaagtcaaggcatgtggtagcttgtctgcgtagtcataaaagaatttatacaagggaatttatgcaagaaatgatgtagaatttaaaggtgattaggcctcctaaatgctttataaaatgccactatgactcttagctgtacaacttgcctgctttatatctaggtaaggcctgggacacacggagtttgatgctggaatgaatcagaccttgtgtgcacttctgtctaagtcccaggcttcacacctagtacatcatttaaaatcccaaacgtaccaaggtcttcaccaaaagtgaaggttgctaagagttaacagtgttacatgtatttaagactattgaagaaacagtttacatgcaaggtgtgtaaggaaagcaaaatatacttttggtaaaaagattataaggaggcacgggaatgtgaatttttgcctagattaaaaggttaaagggttgttttaagttggataaaataaaaatgaaggtttaagcaagttgtgaatggttgattgtaaaggaaattctatttgtaaacatattggctaaagttaaaggggtatcctccagtttttctgcaaattaagcattaaaataaaagcacaatgggtttctcttagagcactagcctgctctttaacaaaaattgtaaagagttataaaaggtctataaaaatcttaccttatgatcaaacattaaaattgggtaaatatgtctataaagttttattaagaattgggtttaacattaatagtacactaatgtaaaggtgaaattcggcttatttggtataaaaattatacaggaagcattgccaaatatgcaatggtgtttggctttctttgggctgtgtttgtataaatatgttattggtatgtgttccaaagttatgggagacttctataattctgatatattttagtgtacattatcagtaataattatcattgttatgttaaaattattgtgtgccacaaggtaacagatttccttgtcaattgtgtctttaactatggctaccctaaaacattttgtcatccataggcaattgttgtcttgttttggtcctgtttagaaggtggtttcataatcagctataaagttttaccaggtgctcttcaatacaggtttctgataactttgaagactgtgacatcagaatagaggaaaaatgttcaggactcttgaagagctaaaatgttcattaatatcaggcaggacaggaattaactacatgaactgaaccaataggagactggagtgatcattttgacattttgcttaaaatgttgctaatcctttgttttgcttttcagagtcaaggaaacgtcttgcgagctattgacagcttttaacaatttagtatactcccatgagcaaaatttggagcttatttgttcctctctacctgattttctccagaatttggaaagtatttgtgactattcttaagttatggcaatatagtgatttgcataagtgcaataagaatctgttttcttttgtaacaggacacaattggagaaactggttattttaccaagactttggttggaatgatgtgctttcctttaaggaatcaaacttgacttatgaagccaagaaaggccttggaaactggcctcctattctgtgtacacagtccctgcacaggggttctgatctggggtaagtaaagaatgtcactttctgacaggccaggaacctcaacaggagaggaattcacccaactcataggtatttaatggtacaattccatggctgggctcagctttaaaaagtcttatctcagattccttctataaaacaaagttccatcaaagacaatttaaaaggcctatgtgaaaaataattattcttgctgcactgtatacaaataattaagccaagtataataaagtaaaccagtcctaccatgtgtcttttaataaaaatggaaaactggagagagaaaattgtttcaaaaactatagcacacctgttgttaaaattccagtcttgtctgatgtttttcaattgttattattttctacagtttagattaaattctaatttttctggctacgagtctccaaaataatgttttcaatttttcctttttccccacttttctaactggaaatcactgaaacctaagctgtgctttcttaaagccccataagctgaagacgagatgtatcagcagacgctccctctacgcccccaaacagagagcgcttccaggaacaaacccacctcttccactcctagatgtatcagcagatgctccctctatggccccaaaacagagagcacttccgggaacaaatccacctcttccacccctagatgtatcagcagacgctccctctacgcccccaaaacagagagtgcttccgggaacaaatccacctcttccactcctagatgtatcagcagatgctgcctctaagcccccaaaagtccagtgctgcattcagtgccccgtaaggaccactctctctcagcaggaagtagccagaaagaacacatcacccctcgtccttttcaactacagggtctggattgacagagcaagaacatcgccatcttggacaaacaccaccattttaagttccccttgattaaaaacccccaaaatccagccgcaaaacatcaacctaatgtctaatatcagcgtgaccataaaccacaaatgacacctttgaccagaaacatgccgaccccaagataaactcccctctgacctgaaaccttccaaccctgccataaaactccctccacccaaaaacactctgaacctgcgacaagctccccttcctaaatccttaaatacctttagtctgtaagagagaacactccagacctaaatcggcccgaagcccctctagggtttattctccaacataaacctgtttttgactattgagctgcttttcatgtttcttctttcttcaactcttacagccagtggccaggagtgagcatttctgggtgtttctctacgggtcagtttctctatgggtcagtggaggccctgcccaggctagaaaaagatcaacaaaaacctaatgtcaggttagtgaggcagttgagtgaaatccggactcacccagaagatgccacagtaccacaggtgatcatcgtcatatcattacagcaggtgaaatcgagactcacccaggagaagacgccacagtaccacaggtgatcatcgtcatatcattacagcaggtgaaatcgagactcacccgggagaagacgccacagtaccacaggtgatcatcgtcatatcattacagcaggtgaaatcgagactcacccgggagaagacgccacagtaccacaggtgatcatcgtcatatcattacagcagatgaaatcgggactcacccgggagaagatgccacagtaccacaggtgatcatcgtcatatcattacagcaggtgaaatcgggactcacccgggagaagacgccatggcaccacaggtgatcatcatcacatcgttacagcagctgataccattgcttgtcgcagacccagctacaccacaggttcagactctcatcttgctgggagatgacatattgaagctaaagatcccctttccctccctcacatctccacccctgtccaaaatcacgtgattcctgttcggccggctttttatactgcagggttctgccagacaggaacacgcctgtcctgcaccgatcctgctggagggcagcttgttccgagccttcctctacaggaatgcatcccatccacgtctcctgacaagctcaggactagtcttgtgctgtccaccccctcaggccctccaccctggcacaggcagctgtgggctcctctctgtgaccctggccagccctgaccggtccacagtcgtccaggaaacccccagagaccacgcagcactgcccagcaccacctggattggttattgttagcaatggcttcaggtggtgaatgacagggtcagccaaggaggaggcactcagggggaggcagagctgcagcacccacccaggaaggctctgtctgaggccgcccaggctgcacagggcaaaggcagtggcaggaagcgccgccctcgctccccccatgacctagggagacggctcatccccctccttaggacaagggacctggtgcggggaccctggggattcccttcccaagaccatcctcctttgagcaaagcctggtggacccgggcgggagctgttctaggtgctgaagcacgtgcatcccacacaccgcagtccctgccttctgggctgagtctagagtcagcacagcgctgggggagctgcccccagagacacagccggggccaccgcgcctcccctcggccccacagcagtctggggtgcacagtcagcgggtagagctggcagcctccgccactgtccagccctgtactgggaacgggcaggcactccaccaggcttgacaggcactgttggccccgcccaggtcacatagctggcaagaggctgggtctgggttcaaatccaggtgtgctgggtgtaaagagaggcagagagatagagagggagacagagacagagagatagaggagagggagacagagctagagggagacagagatccccaaagtgcaccacatcttctaacagatgccgaggctccggtgacatgtaactccctgcggagtggccacagaaacagatctggctgtggctttccatgagaaattccagggccctgtccaaaaatatgcagatatttggacacagccagaaaatgagttggattttccaaacaagcagatgtggatgcagcttctgtggcagcaaaaatagaaattccaggtgttggtttcagacagggcactttacaagcagacagcccaagcacctgtgaccctaggcgaagctctacctcgtaaccaatgcatccataggcgttggctcctgggacctgtgggtgggcgtcagggatgctcagcatggggtgtagctctgctgcagaacgaggaggagcttttcctgctcaccagggcgtcagcaccaccagctcacgcatcaggatgggagacaaccaagggaaaaccaaggtaggaacaggtcgcctgcgcccactgtgtcgggaagctccaggtcagcgacccctctgagtgtcacactcggccccacgtgtccgggaggctgcaccccagcccctgctaaccaggcgtgcccagggaggcaaggctgctcagacagcagaaaaaaacaggcgtcctgaggcgagggcctgctaggcccccactgtggccgtgggacggagccagcagctctgaggtggggtcacgtgcacagctcacagctcggacagcagcaggtggggatccggctccagcctgtctgggctggacgtagctgtcgggaggacgacaggaagcaggtgccgcccgcagaagagaggtgcgtttaagaaaccagagccgccgagtcagcccctgagtggcaggtgcacgatcccacaggcctccaagctcaggggcctaaaacctgggacttggttgattttcctgtaactagacctagtttccgtggcagatgcccaggcagccagaaaagaaggcagggcgggcggcccccaagtcgctccactcacccacccttgtgccagtgcccacccttctcccaaaattaacccaagtctggagggttcaggtggcagcatctttgagcagagagtgggggacgggacagggtcctctttgaacttcaccccatcccctgcaggtgtggcctgaggcgtttgcatggaggaggtgtggactggtgtcctgggcaggtcccaccacggtccaggaggggcggcccggaagactcagcttcagctcacaggccgcacatggctgcacacagagacctgccgatgccacaggccacgtgcacctggaaaagtctgactcaagccacctgtggggccgcaggggtcccatggtccctgggcggggatgtggggccaccggcctgagaaacaccccccagtgcctgacaggcacggagagctggggcctcatcagggccacaggagcttcagggaaagaggcctcggtggtgaggctgtgggcccggcaggaccaaccccgagctgggtgcccagcgagtgtggccgcctgtgcccatgctccgcctgtgctccactccctcagttattcccccgctgtgggtgaggtcgtgggatccagggttggatggcaagtggatggggcccactcaacgcctgtcctccagaacacccggcccttgtgggacctactcggggccgtggggccttggcacgggctcttgccctgggcagctcacagtgtcctcaccggtgacccgcagagccgcccaacactgccatccagggatcccagaaaccactctccaccagccccacccaaaggggcggagaccctcacagcttccacaggagaaggtgcggggcccgacgccccaggaaggctgatggggctcccacgacagcgaggccctgagcagaagctaagcagggcgcaaggaaggcggccgagacctcaccctccagcacttagaggaatggagaaaacgggctcagtccagaccaaagacttctgtgtgtggtgtgtatagtatgtgtggtgtgtgtggtgttgtagtatgtgtggtgtgtggtttgtgtagtgtatgtggtgtgcattgtgtagtgtgtgtgtcatatatgtggtgtgtgtagtgtattgtgtggagtgtgtgttgtgtgctgtgtgtggtgtatgtggtgtgtgtggagtgtgtggtgtgtggtgtgttgtgtgtgcaatgtgtgtcatgtgtggtgtgtgttgtgtattgtgtggagtgtgtggtgtgtggtgtgtgtgatgtgcattgtgtggtgtgtgtcgtgtgttgtgtgcagtgtgtgtggtgtgagtagtgtattgtgtggagtgtgtgttgtatattgtgtcttgtgtgtggtgtgcgttgtgtggtgtatgtggtgtgcattgtgtgttgtgtgtgtcgtgtgtgttgtaggtggtgtgtgtagtgtattgtgtggagcgtgtattgtgtattgtgtgttgtgtgtggtgtgtggtgtgtgtagtgtgtgtggtgtcgtgtgtgtagtgtatgtggtgtgtattgtgtggtgtgtgtgtcatgtgtggtgtgtgtgtcatatgtgtggtgtgtgttgtgtatagtgtgtgtggtgtgtggtatatgtggtgtgtattgtgtggtgtgtgtcatttgtgtgttgtgtggtgtgtgtgtcatgtgtgttgtgtgtgtgtggtgtgtggcatgcatgtgttttgtactgtgtggagtgtgtcgtgtgtgtctgtgcatgtgcacatacgtggggcacaggagaattgccagttaacactgttttatgcccttccctttcccatccctgtgggacctatgggactgtgccaggttacagagctcttcctgaaataaatgattcatatgtctgtttgggtgaggaggaaacagtaactcattcagcagtggaaaaatacctaaagctgatgtgatttggggcattcttcagatgtcaccggagactaacatgataatgggtagggataatggcgaagccattcctaatgatcagatttcatcccttaagtgaacagagtgaaatctttataaatgaaatgatgccacgtctggcatttgcttctaaacaacataggaagagaagaagcaggcggggggtgaacaggacaagtgatggagttgggtggggggcaaggagggttcattgcgattttcttcacccttgtatgtgcttaaagttttctatggtaaaaatttaaaataaaaataaattgagaaaaaagtgttcacgtgtatctggaagcactggaaatacactcgttctctctgtagctgacgttgacagcctgccttgctgccttttgaaataacttgaatgttctgacatctatgcacttaaaaccagtgtataacaatgaccaccgctttctcgaaacctgtcatgaacaagacattctcatgtgcattggctcaaatgttcccagccaccatgcaaatgaagaaactgaggctgaaatgcttcagtaagtttcctacgatcacgcagcactcacggacagccaggttccagctaccacaagtattaaattaatgtgagattgtgaaatatgggttcaccatacaacatcagcccagaagaatgcctctcctgaaaaggcagaaatgagcttgcacaggcatcacagacaacccctcagaggttctggtctggggcatccgggtgccttcctcaccccagtgagggaagcccgtggacaggtgaacaccacacggctctggcagtggccgtcactcttgggtctttatcctgtcattccagtacccatgtgtttttaccgaagccatagaaatggtccccatgcatccagattgtaaaggaagaagcaaaagtgtttctatttgacatgctccagtagattaaaaaatcctgaggaatccattttttaaagaactactagaacaaagaaatgagttccacagggttgcagatattagatcaacatacaaagtcaacagtatttctaaacacttgcaatggacaacccagaagttaaattaagaaaacaattccactcaaaatagcctcaaaaagaataaagtacctaagaataaatttaatttggtaagtacttcatttgataaatactgaaaaataagtaaatttgatacaaaacttatactctaagaactacaaaacattgttttaaaaactaaagaaggtctaaataactgggaaaacattccatgttcatggattgggatacttaatattaagatggtaacactccctacactgagctacagattcagcacatccctaccagaatcccagctggcttccttgtagaaattgaccagttgattctaaaattcatatggaattgcaagggattcagaattgccaacgtaatcctgaaaaagaacaaggctggaagactcacaagcccttatttcaaactcactctaaagctacagtaatcaagactgtggtaccggcacaagcaaagacatatagattaaaagaatagaattaaaagtccacaaataaaccatatatgtatggccaattaattttcaacaagggtgccaagaccattcaatgagaaaagaacagtcttttcagcaaatggtgcttggacaactggatgtccgtaaatgcatgaacatgggtccctacctcacaccatgaagaaagttaactcaaggtggatcacagaaccagatggaagagttaaaactataataactcctacctcataccatacgcaaaagttaactcaaagtggatcacagacccagatggaagagttaaaactacaaaactcttctagaaaaatctaggggtaaatcttcatgtccttagatttgtaaaacattcttagatatgacaccaaaagcatgaacaacaaaagaaaaaataaattagagttcatcaaaattaaaaacttttgtgcctcaaaggacaccattaagaaagtgaaacggcaatgtacagaatgtgaggaaatatttgcaaatcacatatctgagaagcgatttgtatctagaatacataaatgactctgatgactcaacaggaaaaggcagcccaatgtaaaaatgagcaaaggaaatgaacagacatttctccaagaacatatgcaaacggccaataggcacatgaagagatgctcgacatcactaatcatcagggaaatgcaatcaaaaccacaatgagataccacttatcacacattagatggctagaatcaaacagtcagtgacaagtgctggtgagggagtggagaaacaggagccctcatgcctgtctgtgggaatgtaacatggggcagccactttggaaaacagtctggcagttcctcaaatgattaaacagcattactgtatgacccagcaattccactcctaggtacatgcccaaaagaaatgtaaatgcattttcacacagaaacctatgtacaaatgttcacagcagcattattcacaacagccaaagtctgtaaacagctgtaatgtccatcaactggtgtatggataagtgtggcccatccatacagtggattattattattattatcattgttattattattatttgagacagagtcttgctcagtcacccaggctggagtgcaatggctcaatctcggctcaccgcaacctctgcctcccaggttcaagtgattctcctgcctcagcctcctgagtagctgggattataggcatgtgccaccatgcccagctaattttgtatttttagtacagacaggatttcaccatgttggtcaggctggtcttgaactcctgaactcgtgatccgcccaccttggcctcccaaagtgctaggattacaggcatgagccaccgtgtccggcccatatagtggattattattcagccatagaaagcaaggaaatttggaggaagcttaaagacaccatgcgcagtgccagacaccagacacagagaccgcacataacacgttactgcctccacacacaagcccagagtaggaatctacagagaacacatatcacacattactccctccgcaggcaggcccagagtaggaatctacagagacaggaagttgattcctggttgcttaggctgggtaggtagggtgctaagagaagggtgtgggtttcttgctgatgtgattcatgttttaacactggctgtgctgatggttcacatatctgggaatacactaaaaaccattgaattgtgtgctttaaatgggtgagttatatggaatgtggactatatctcattaaagccatttttttaaaaggaaagaaaaacagacccacactgtccacccatcctgtgcatcgccaaagcccagcttcacacccagcttctgcctctttggggaaatcttatggaaaagtcttcaggaggccttccctcctcaggcccacccaactccctacaggcaccaagcagctccagactctgaagagatgctgtctagagaccatcatgggggcatgctggctcccaaaggtggcgtctgtttccaacaccattctgtgactggtgtgtgtgaggcctttgcccaccctggtcagctgtgacgcccaccctcgggagccaacaacagggggtgggtgggagaggaaatgccgggcctatctctccgtctctttgcaactgctagccaagaacggcagctcaccctgcagtgcacactgtctctactatgcagaacagaacgctttgctccaccagaatcccagtgtctttgcagccacccccaaccctccagggacctcccaccctcacacggtcaggctccatctgcccaagggtcagtctcctgggcagcagtgggagtttgctgggtcccatgcggggtgatatggtttggctgtgtcctcacccaaatctcatcttggatcctcatgtgttgtgggagggacctggtggaaggcagttgaatcatggggggcagatctttcctgtgctgttctcatgatagtgagtaagtctcacaagatctgatggttattacaagggggagtttccctgcacaggctctgtctttgcctgctgccatccacgtaagacaggacttgctcctccttaccttccgccgtgatcgtgaggcttccccagccacgtggaactgtgagttcaattaaacctctttcttttgtaaactgcccagtcttgggtacgtctttatcagcagtgtgaaaacagactaacatacagggttccgagggcatacaccgcggcccagccatctcaccctccctctcggcctgggaactgggaacaggcaggggttgggggcccgacacaggtcatttgcacgctggatgatacagtaacatgacagccggtgcagggaagagctgagaactccagcctgctctgaagcaacaactgggagatgaggcagaaatggcccaaccacctcccctctaaaccctgctcttaaaattcaatcctggctgccaccgtgaactgacaaaattagccagtttttgtttttaaagttatagtccccaaaacagtgcatcaacaaaacagacttccagctgaacctgatcgctgttgccgcgcatacagccacgaacatcatggacaggcagtgtctggatttcactctgcattgctgccatgtgaaccgggggctccctcctggttttatgtctttacctctcctcttagtctgggcaagataaacattaaccaaactcagacgaaaaacaagactctagagccactggttcaaaaggaagagaggcttatgcacatgtttttgcctgaactttacacactaggacttaatttaatttgccacccccgtcccaaacttcatgcattctctgagcttcccaggcctcagcattggtggttgcacaccacgtgaggttgatacaccagcaacccagggccatgctcgcttagactaaggtgtgaatggtactcgctgaaccctgtatccaggactgtgcaggccacagcccgggaacctcagagctggtcctgtagacaccagtgtgctggggaggcagggctgactcttctcagagccccagtgcagctgtaccatcccctgatgagggactcatgctccccaccaccccatgtactttcttaccatttgccttctattctccaccaagttgatgccaataattcctaagaaagatccaaagccgagctaaaaccaaaggaagaacgagagagaaacactcattaacgtgcctagaagcttaacactgacatttaaagcaaataatcccgccctcaaaggcattttatccagggacgaaggccagacatccctacctcaagaacctcaaccactgagcagcaggtgcgtctgctggcgttgggcaggcatctctgcaacatcacctgtcctgtcttctctgctcagaggtttttaatgatgcatctgtttggcttgtgactctggggtaagagaagttcccactcctcccccagagacaacatcttttcgggaacccagggccaccaagcaccaccatctgtcccgtcttctccaggcctgagatgcccctgagcatggctcctgggtaaggtattagggaactacagccgtgtttcaaaagaagggttgccaggcacaagggccaccagtgacccctgctcagacggcctaactctggttgctgcttcgggagagtgagcagggcagaccgttagcagggaggtgccaggtgtggggaaagggcacctgagccaggcacagagggggcacctgggccaggcacagagggggccccgggctgcagcacaggccaccaggggtccggcagagcccccttactccacaggaagccccagctctgggcagaaaatgatactgggatgtcgggaaatagacatgggactgtgctgtcttagaacagaggccaccggccgggcatccgcaccctccacccagggcccgtcctggcaggtgacgcccacctggcagaggaatttttaaaatcagtgtgaagaacatgcatttcagcaacacccaccgaaaatctggctcagagcagccaacatggacctgccaacgaccgtgccgaggcctaagacggctcttgctcccacgcaggtgcgccgggccggtcgcacttcccagtgagtgtctgttggaaggggtggcccgcccggcacagccttggagttgctggggccgtggtgtcaagtttaatgcactggaaaccggacttctttatgtaaatagttttgccttttctgtaattgtctgtgtgtctgtggtgatagacacgtacacatgtggctttcaccaacggtttgagaattctccagggataacaggaatatttcttcatgtgctgagcttcaaaatactgcagttcaactccacacgtcaaaaatatcaaaatttcacttcgatatacatgtattaaaatacatctgttacactacgttttattttttggggatttgaaaaaaaccacacctttcttgaaaatgtggagatgttttcacgttctggccgcttcttctgagatcagcttcttaagtctctacattggcagaaagtctccacagaagtgactcttagccacgtttccttgaagctgcttttatttgttgtctccctagtttgctttcagaactgtctgtactacaggccatttcaatctggtcagcacagcattaattcattgcccagaaggtagattctttacagagcatagcttgggcattagccattgatgtttttcattatgttattctgaggcagctcttaaataagcttgaggacaaaccaaaaaaaacaaccactcaaggctgatcttgatgtttcgcaaatcacttggaggtccctcctcacagccacttgccctctgggctcccctttctgcccaggaagcagaaaagcccctcacatgaggccaaggtccccacaccattggcctcttgcaattttactgataaagctttttctgcatagatactatttgtatatgtttattcataaactatacacaggtagatagtgtagatgtctaaggcacaccctaagatataaacaaaggaaaatataatggtgaaataaacagtatttgtaaaatatttctaaatacttagggccaaaaatctttcatctttgctgattgtcatcaatattattaccaatcttggtagtactttaggtgagagtaatgagattgaagaagccgcattttaaaatcttgctttagcactttatgacgtagcaaccaggctctggggcatgtgaagggcatcgcagctgatccaagccattccaacagaggttcactgtgcagaatgcaggcacttaggagaattcttttactaacgacagaggatgtaatttcatagttcaaaaaaccttgatacttttgaatctgggtgaccaattcttgccaattaggttaccatcaatttacctcgccgccttactgttcaaaatctggcctgacgggtggatgaggtcagcaccaccaccttctggccgttcccacgcgatcacgtcactaatacgatctttgacccacggcttcttggtaggaatcgtttaaagttactttccccttccatgggctatggtggtcgacctggtccctcagggtaaaatccttccaggatgcttggggaggctctgtccggcctttttggacatcctgggctcctggcccctcctccaccttggacatttcctgttgccgggctctggcccccctcctgccctctggtcaccctgtgaccacatcgggccaacccagacaatggagggcacctggccctattttgagatcaacttggacctcaaccccaattcccctctgccttggacctgccactgtcccaggtcctggggattgggaagtgcatgtctgtgggggccataaccctgccgaccacaagcactgatcgaagcctccccaccttcagccccagccctgtgagctggcgtggactccaccctgagagagccacacaccaccctgccctccccggcccaggccgcccgcccggcgcactcacaatgatccctgggtagtagcccccaacggtcacattctccgtcctggtggtggcagccagcccgacggtgactatgaggacggacaccagcagcagagaccccacaaaccagagcgacgtcttcttcctcctcgaaagcccttctgtggggaggaaggcgaggacctgtcagtgagggctcaggctcaggagggcgtcaggccagcaggctctgggccgtgctccgttacccaggggtcctgggatgcactatccccgcctgcctccaggcccacctcaggggaccacccccaacctccattagataacagaataaaatctctggaccataagccactatactggatagcctggtatttgcggccaaacctaattctaactgtcacagaactcaagaaagcaaactagaaaggactccttcctattggctgcctcttcctctatctgactttctccccctggtgtccccaggaggacaggagcatcttttgtttactgttttatcattaccattcgctcacagacacaccctctctatccgcctatcccagccacacccagtgggggagggggctgccaccaggggaggggcagggagagaggaacgcacacagcagccatccagctgtgccatctgttttgctttattttttgaaaactgaatcatcttgatccctgtgtgactccaaacaaaataggggatttaaaaaaccatggtaaggtcttcctactccaagagtttgaaaatcaacatttgtgtgtgtgcacatgtgtaagtgcgtgtgtgcagggaaagcagaccgcacactggagagccgctggcagcgatgacggccgtgcagacattgtccacaccctagaaggtccgcatctgaagatttacacttctgcaatcccatcagcagagctcaatggcaaggcaaggttatcgcacccaaggaagggattgttacatcctcagaaatgagtttcacaaaactataaatcaatgtgcagatgcagaattgctctgctgatctgagagagtcatttttatccagctgacccagcaagggcgtggccttggtcacggccttccttcaaggccctcttggactcagcacagcccccggcacagcaccctgcctgcctcttgacccttgcaaagatacacttgtcccaagaatctcatcctaaatcgctttttaccttccaccttggaggggaccagatcactccattcgccaatgtaataaaccatcggctcccaccagccagccaggctgcccccgtcttggacccactgcaccgaggcggccagtggcactgtccttagtgttatactccaggccgcaggcagtggtttcagcctctccctggttgccccatctcctgcctccttagaggcaggcttgttgcagcatccacagggcctttgtacctgctgtctccagctagacactcgcagcactccctgaaggcctctcttacatgttgctgcatagacacactgagtatagtagccacactcacccctgtgctctccacagttgccccttcacccctgcccctgcagagcatcctcgcatgtgagaggcagaggggacaccagacagacagaggcacacgctgcaggcattggaaaaggccaagttcagtggagaaaacttaagcagggctggggacagggcgctccggatgtgtcacccacaggcagcgggcagagggcagagccttccctgaggggcctggtgatggcacagtgcacccctcagcccagcaccactggtgtggagtgaggccctccttctgaaagccaccctcctgagacaccagaggccgcagcccggtgcgggccagggagcaatccccacacccagcctcaggaacacgccctggggttcggggtccctgcagccagggccacacctgcgccctccgggtccccaaggcagcttctgcaggggtcacactgaataaacctagaggggtgacaagcaggtgggtgcaggggcgggcacagcaccaggagccccaaggccacactggcggcccaggacctggcacctacacatccatcacccagtgtctgttaaagtcatgctcccccagccccaacccgtgtccccgtgtcccacgcccacgccccggcccatcccaccccaggccacacctgccttcctgtgtgcatggagcacgtcctttcttgtctttggatggggaggacactcccctcaagtgaccgaggcccaggcacccgacacctgccctgcatgaggggatgggcgctgcacctgccagccggaacacacggcccaaggcctcctccagctccgcctctcagtccctcgcttctcagcctcaggcttccttcctcctccccacctctaactcgcacagttcttccctgtgtctctcatggtatttctgaactaaaagccaaccctcgttggactggaaaaggttgggaagatgataacgacattcttacaaggaaaagggagacagtgggtatatgttggaaagtgtgatttttacgctgctcagaagagcagagtgattttttgtagaacactcataaagtactgaaaaatgcaaaagggaaaataaaattcatggtaacctaaattaacaagtaggcataaaatcttatggtcttttttcaatgcactatgtactttttaaaacatttttttcttaaattaggaccacaatgctttatagtaattttttcactgaaatcttgcaatttgttaaaaacctgaaaggttatatgttcacggtcgtttgcccgagagacaggagcgatggcgacagatcccgggtctctgtcgggaagtcgaggtgagaaacggcaaacccacgctgggagcaagtgggcaagaggaaggcaggcacctcccgtgggtgaaactccgttctggttgattcgttttagaaaggtaggtaaactttttaaaaatggacacaaaatttaaaaatatatgcaattccacattttggaagttaatgaaacagctattgtggaattacacaaaataatcatattgatgataataacaccatctatggattgggctgtgtgtcgattttcagagcagcctaacttccttatctcatttgatcatgaccagaggctccaggtcaccctcaccagcctccatgtaacacctgccaatgcagccaaatgctaggtgccttcaactcacacaattcccgcttcagcctttcctgcttttccttaggctcccattccaatcttttgactgtttaaatgtattttaagagcaatacaatttctaaaactaaattttatgggactaagtatttgagaaaattatcagacaaacgctgtccttctcaaaggattttgttgtgcgatttttcttaattaaatgcactgcatgcatataatattatgctcaaaatagttaaccagatgactcagcgtctgcttcgacccacaggtagaaccttccgtggggctcctgtcccagcctcctgtgggcgtccgtctgtcaggaaccctgtgactggattctggttcttaaagctggaagctctgctcggttccttggcatgaagagtgggggcccagcaagacccactgggctaactgaccttgtcaagtcaatcggtaacatgctgacttgttaattactatgcgaagagttagacacatctcctctgaaaccacgtaaatcctcctacaaaccattttcaacctaactttgctatgtttacccctctttcctgagtctaacttcccccccatctgctacaaaataaaaagcagaaggtatgagccacccttttatcagcattcctatcacagattcctagattatacaagtctagaaagacagtagaacttacatggggcactgggagcaatggttgcaaatcatctcattcaattacacaatggtgatattttgactccagatataatagagataacaaaaagaagactcccaaccttaaacacattctataaatacatgacacagcataaaaatgagaaaaaaaataaactcaagaaaagaaggtgggatatctttataattagcataagagataattataaggtcagattttcaagagaaaggggctttcacttaggagaaagataattaaaatcacctgaataatttccttgatttttttttttttttcctgtcccggaaatactgttattacacgcactgtgaaaattaaagtgctcctaagtgccccaactattaattaaaatatctaccaataggtttctattgcagaggcagcttacagggactggacccaaaccattctgggtctgtccagacccattgtgtggtcttgggcggccatttaatctccctgagcctgggagaagagaaccctatgagagccaagagctctgtctcttgtttgtcgccggttcccggggctcagatgaggacatagacacatctcctggtacggaatgaatgaaggcacttcagtctcctgacctgtaggatggaaatcatgagaaccacctgctcacccacctcttgagattgtgataagcgtccagtgagacacgatacgtgggctctcatataggtttttgtaaatggaatgcatatgctaatcatcagggtggtgtgaactttaagatggcgtagcggctattcttaaccagcatttctcccactggagttgcaaggaggagttctgagatgtgaagctgaaggggccaacagctacctctctgctatcaagtgcgctgatttttctaattctagtcttccccaggtgcagcccatctaggatatctcagaatatcaccttgtcactccccaccagcccccacttctcccatcccacctgctctccccttcctggctccttccccagccttagctggaggagctgaaccacaggagcctgtgcccacgccaggtcctacctggaagacacgcgaggctggaggtcaggctcttcctgcccctcagacccatttcctctactccacagagccaggaaggggaatgtcacaaagcatgggaggtggcactgcttggaagggttctaagatccggccttcctgccagccggacctggaacgcccaaaaagaagagtgagttccatttaatcatgtggggacaccagtcatggtgtccaagtaacaatcccaggtaaaactgtaatcactcagccgtcaattcctctttcgtcctgattttacacatgcccagggtagtgaacaaagaagggcaaagcagaaaaacccataatcctacccccaggtaccccaaagcagaaagactatggtccacccccagataccccaaagcagaaaaacccacaatctacctccagacacaccaaagcagaaagaccataacccacccccagacacaccaaagcagaaagaccataatccacccccagacacaccaaagcagaaagaccataatccacccccagataccccaaagcagaaagaccataacccacccccgataccccaaagcagaaagaccataatccacccccagacacaccaaagcagaaagaccataatccacccccagataccccaaagcagaaagaccataacccacccccagataccccaaagcagaaagaccataacccacccccagataccccaaagcagaaagaccataatccacccccagacacaccaaagcagaaagaccataatccacccccagataccccaaagcagaaagaccataatccacccccagataccccaaagcagaaagaccataacccacccccagataccccaaagcagaaagaccataatccaccccgacacaccaaagcagaaagaccataatccaaccccagacacaccaatgctttatacattttagtaaaagaccagctccaaacaaaaagacccataatcctacccagatacaccaatgtttcatatactaaaaagaccagctccaagtattgttttaaggtttaaagttctttgtcagaagaaaatctaagtcagatgctatttttaaacattaaggcattctaataatgataaaactagttaataaataataataatagttatcattattaaacaccaatagactaatccacattaatacatttgaccatagagcattttgctttagattggaaggcatatagtggtttcttttagaaagaagccaaattatttgattattttaagtaacagtaattcgtccggttccgaacgatgccgcagtaaaagggttgtgaggttaatccccagaagtttgtgttggattatttctgagggagcggcagagccccctagacaccactccatccctccctccagccgtcagggcttcactttctagggaactctgtttctcttttgttctgaaatctgcccagccctctccccctcaggaagacacccggcatccttccagtcctggccacttcccggcagagcccccgagcccggcttgcgaactggtgaacacgcaacaggtttcctgttttcccagcctttgcctggctccgaggctgcagcgggcttggtctgggaagtggaagaattggagattccgtgaacacaccggggagaaacacgagagaggggcgagccgaaaccaagcaacactgtccagttctgtgagcgcctctgcacgttcaaacaggaaaaggctacctcgctcttccaaacgaagttttcccggaaaatggtgtaggttggaataaacggaagagatggggaaggagcgcactttggggcgcctgttcctcataataaaacgtaacagggagagagagaccaagaggaacggacacagagtcagaggaaggcaaagactgaggaggcagagacagaaagagcgagagagacagagacagagacagagagagagacagggagagagaatgaatgaacgaaccggtaggacgaacgcccgaccccagtgcgaaatgcaaagtgttccaaagacagagctcgaaggaggcggagggaccagaccccgtgccgcgtctccgcgcaggttccgcccgggccggccggggacctgtagtcccagccccggggtccccacgctcccccgcaggagccgagacgagcccccagccccgcgctcacctgcggggtccagcaggcccaggggcccgggcaccggcggctgcatcccgaggccccacccggctctcccggggccacagccacagtcccgccgccaggagccgccctcgcggcgccgccccttccccgccccctgcacctccccgcgctccgcccgcctcgcgtccttcctcgctctactctcccttctccggcgtttcttctcctccctcccccgctgcgcccgctcccccttctcccctccagcggccgcctggtttctggaaatcaggacgccgcggccgggagtggaagccagaccccagatggaaggtgcctggagaggaccctgcggactcggggtcggagccccggcctgggacggtgaccccgggccttccgccgctggcgccacgctcagcccttggcggtgccgctgagtgggtcaccacgggttcgcctccccattggccggtgacggagctccttggggctacagggccagccagcccttgatctctgggttcagagggtggtacatggtgttacaacccagtctgcgaggaacgagtaaatgaggaacaaacgcaaatgagtaaatgaggaacaaacgcatctggcacctcactcagcagccccgaggcagggctgacccgcctctccaaggcctgcgtctttgtgtccacagcactgaagttgttctgagtaaaatctgctgctggaaagaagggcaaggaaacacggggccagaaagggtgcctcgtacagcagcaggaaaaaataaagatccttctaaacgtatttttaacatctttgagtcaaggacatcagcggtcccgtcacaaaagaagatgcttgaacgatcaataaactcagcccccggaattaggggaacgctgtgggaacaagaggatgcgtttcaccctcatcctatcagaaaaccccaagggtcaaacaacttaaagaatgttaatgaaaacgtgggaatctgcattcaccgctgggatcacgcatggtgccaccactctgaaagcaacctttaggaaaattgaagcaagtagatgacaagccagaaagaaagcatatctctttctagatatgcccaagaacacaaacatagatctgctccttcgagccaggagccgtggttctcaaccccggctgtcgttaaagtcatccaggaatgtctttaaaagaaaaaacatttctgcagcactgaacccagaccagatcaattgaaccagaacttctgggaacaaactaatagctaagaattccctagtcattctaataggccatccactgtgagagagaaactaccacaagaagtatgcatgtgctagaagatgcgtacagaatattcctcacaacactgtgtgtccaaagcaccggacacaccctgaatatccaacacggggagaagcgataaagaaatgggcatatacagcgaaataccacatggcagttaaaataaatgagagctacatggatcaatgtggataaatgccaaaaacagaacgcggagcaaaaatgcaagtgcacagtacggcagcgagtacgacagcaagtacggcagcgagtatggtaccatttatataaagttttaaaccatgaaaattaacactgttcactcagtgagcctctcaagacttactaaacatccgcgatataccagacactgttccaggtacttgggatgtatcaatgagcaacgtaaacaaggatcctggtggggaagtgaggccatgaataataatacaataaacaagaaaaatgcacagcatgtcagagggcaacatgctatggaatacacacacacatatacacatacacacatgcagacatacacacatgcatgcacatacacacatacacacacatgcatatatatacacatgcatacatacacgcatgcatgcatgtgtgcatacatacatgcacacatacatacatgcacatacacacatgcatacatgtgtgcatacatacacgcacacatacatacacatacatacgcacatgcatacatacacacttatacgtgcatacatgcacatatgcacatatacatacacacatgcatgcatacacacatgcacacacatacacatgcacacttatacatgcacacacatgcacatacatacacacacatacacacttatacatacacacacatacacacatacatacatacacagccaggtaatgcaggccacagaaaaaggaaagagaggtaaagaaacaaaatagaaagtatagtgtgggagagggagggagctgtggtttttaagtagtgaaaagagagcttgttgacaggtgatgttgaagaccaagcttgagggcgtggaggtggttgctcacccagacatctggggcagagggtctgaggaaaaggaacctccatgcaaaggccctggggtggagccatccaggcccagggggagcagcaaggagaccagggtgccagaggcttgtggggaccaggtggaggacatcaggggtgagccgcagggcctctggcctttgctccgagtgatgtgggggttattggagggtcctacacataggattactggagagtagttgtaggatagcagaatggaagctgagaaactggttataggatatgatgaaacagtaggaggtgattacacggacaccatgagtcatgtttgcagatacacggacaccgtgagtcctgtgtgcagatacacggacaccgtgagtcctgtgtgcagatacacggacaccgtgagtcatgtgtgcagatacacggacacgttgagtcatgtgtgcagatacacggacgtgagtctcgtgtgcagatacatggacaccgtctcgtgtgtgcagatacatggacaccgtgactcatgtgtgcagatacacggacgtgagtctcgtgtgcagatacatggacaccatgagtcatgtgtgtgcagatacatggacaccatgagtcatgtgtgtgcagatacatggacaccgtgagtcatgtgtgtagatgcatggatactgtgtaagtaaagtagaagaacatgctgggggagagtgcatgcttcatccagaactgtgattctctgtctgggtggacaagctgaacagctttggaactatgtctaggggcttaaactctatttgtgaaatcttctttctttaaaaaagttaaaagacttgtaaaaaaagggggaatgttgagataccattaaggctagatggtgtggacagggatgttatattattctctatacttttctggatgtttaaaatagatgattacttttttgtaactttttatttttatctattttcaaacctaaaggtggtttgcagggatagtgcaaggagctcctgtgcatcctctacccaggtgtgcctttgtttgcagtctgtcacttttttgttttttgagacatgctgtggctctgtggcccaggctggagtgcagtggcatgatcatagcttactgcagtctccacctcccaggctcaagcgatcctctcacctcagcctcccaagtagctaggaccacaggcgtgtgctgcaacacccagctaaggtttatactttttgtagagatggggtttcctcatgttgcccaggctgatgtcaaacccctgggctcaagtgatcctcccatctgggcctcccaaagtgctgggattacagacgagagctactgtgcccggccacagtctgttacattttaaaaattaaatggacgaaaggaaaagaaaaggaggaaaaagggcgcctgcttggctctgcaggccgagtcccaccctaagccgccagggtgcccaacctcttccaccactgagagcagcccagggatttccatgtttgtctcattccaccaggctcagggaatgcctttttaaagaggagaaaaagcgcctgcctggcatggggaatgtgcaggggccaactggagcacagccaactcagaacttcttcaggggctccctgagcaggccccacctgcctcctctccccaggcctgcacctcggaagtggctggaacccacagccagcacctgtccttccttcccgccagcaccaccttccttctctactcactcagagataccggggttccccatgactggttcatcctcccctcacccctaactttccgtggtcctcagatctctaacccattcctgcaacatccagtgaggtagggaagcaacagcgctggctccgagagccagggtcagggccaggggctgactcccacactgtcctgtcctgagcattgtccaggcccagagcagggctgggtttggcgctgggctgtggaagcacaggagtgatcactgacctggggccctgatggagctcagaggctgatggagaagagacagaaagactgagccctcccaggtgatgccaccgtcttaagctcagcgctgagaggcagcgggaggtgtcgcagggagggctcccgcaaggagagacacacagagctaagagctggagggcagggagccaggccgctcgggcccttcctggaggatcggatgaatctgttatctctgagcaagctccgggaaacaggagacaggtcgggggctggcttgatgggggcagtggatggggttacccaagatacgctgcgacctgtgagcgtccgggaagggattcaggcttgggaggagtccaggagacagaagtcataggattgccaatctttacagtgggacaggtccttggaggtcattccggttactacaactgtgggacaaatgaccccataactcagtggcttaaaaaaccacatttatttagttggagttgaaatttgggcaaggccaggagtggacaccctgcctctgctccactcagggtgagctagggtggctcccaggactggcgcgtggctgactgtggctgtgcctgtaacctctccaggtgacgtgggcttcctcatgacatgggggctggactcccaggaacgttgggcaagagagagagccgggtggagtctgtggcaccttctgcaacccagcctcagcttcacgctgtgtcacctctgctgccttctcttcagcagcccggtgacaaaattcaaaggaagaaggaagagcctctccttgtgtgtgggaaatagaaaggtgatgtggtcatttggggaaaatagaatttgccacagggatcactgtgtcaggacaggaccctcactacagggaggctggaaggtgaacaagcgataataaagataacgaaccttttcctcttacttcagcagatatttcgcagctatttgggcagcttggaatgggaactggtggtcttcctagaccacaggtaatgaggggtggcgtggaggaggcagccgtgccaggcaggaagatcatcctgggatctgcgatgtgtgcatcggaagcacccagagagaatagaagctgccagaaaaatgcaaggaaacccagaaactcggagagcacaaacgaatcacagtttttattgtgtgaattttcactaaatatcctacaatgaatattcgtcataagaaaaagtcatttttaatgtcatgatttcctggaaatatagaaagaaagaaaaacagaaaaggcacaactgcccccgagcacagcagcagaatcttggtggtgggcgctcccctgccacgcccggggatgctcctgcttcaggagttcacttggctcagttatggcagcaggttctgatgctgcagagctcagagcagaaaggctaaggacgcctgcttagggcccctactgtgtgtgtgcatgtctgtgtgcacgcatgtgtatgtgtaggtctgtgtgcagggctgtgtgcatgactgcacgtatgtggatgggtgcacatgactgtgtacctgtgtgtgtatatgtgtgggtgggtgcgcctgattgtgtgtgtgtgtgcgtgtgtgtctcacgccagattggttctgctcaggtgctctgcatcatttctgcaatctgatttctccaagtctcaaaggtcgaatgtgcaccatcaacagcactgagagcctcttagaaaggcaaagtctccccagaccggatgcactcccagcttccgtgcctggaattagcgtatttcctgcaacaccaggccgggcagagctaggcaaagtcacccaggatctggagttgccagaatgcagcttcggccactgacagcatcatcatggccacataaaaaatcccccaaataaatttccttggaagaagtaaataagttctttgtacttaagtttggaggtgaccagtcctaactggtaactgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggacctcttgaaactcctctttgtcctagcacagctggctggaggtagctgagcgggagggtgggagaagcccacaagacctgcccatgccggctactacccccaacccaggcttcctctcacggacaggtgggacttgaaaccccacttggcttgtccaggaaaatccaccaatccccagggtctctgggctccccgagaggcattgcgggatgtttctagcagtcttttttcgggaccactttatgtctcgtgaggatctttaccttgatgtgacagaggacaggggcccaggaacatcaactcgggtgagcggtgctctggtgctcccggcaggaacccaagcctggctgttggccaccggcttgcaccgagcacacactgctccctggcacacttggctaaaggtgttgactgacttggccaacgtgaaacattccattctagttaaacactgagttctccgttcccaggagcttgcaaaccagcacagccttgtgaggaagtcatgtggcagaggattctccaagccctaggtgctcaggagagccttggagtgagcggattccagatcccacagggcctccagccgcatcggagccgggaatgtttgcggagaccctggcttcccgcagctactccctcttcccacaacacccccttggcccgggattcaaatacaacagggatgattccaaagctttaaatgatgcttgtgatggaagagaccagacctcctcccagagctcggcagagtcacatgggccactccaggcaggtcactcagctcagcccacaggcccaaggggcagctggggaatggggctcttccagggaaatgagaccaatggccgaccacgaggggctgcccccaacagagaagccacgagtggggcccagaggtggagcgcagagcctttgcagaatcaacaggcgtccagggtgcatgtgggctcaaggcagggcctcagtgggtctggaacccagcggattctcactgtgctcttgccggcctctctgggctgccctccgtgagcgctggtctcctgtgctccgcatggcccaggcccagacacaccccactggtgcccccgtgaagtcggccaccccacgtctcccgcatcccggaggcctccctgtgaagtggacgcggcgtctcacacatccgggcacctgtgggtgcacgtggcactgggcatgtcatggagcccaccaagtctgcgaggggtgaggagctgagtccctgcagaaaccaaggccacgtcggactctaccagtggtcagcaaggcccggcccttctcctcgggtcacagggctggaaatgcctcctgctcttctccggcagaatctcagttgtctgggggcagccacaaagctccagggaggatgcgctcctgggccgtggtctcgaaccctgagggtgctggtgcctgggggaggctgtgcagggtggacatctttgccagacaggacaagcggccacacagaagcccggcctccctgctgcggcacctcccatcgtgcagttttgggcaaatccagcaggtgttgagggaaatgtcagccacaatggggctcaatccctccctccatccgaccccggcctctaagtccgcactgtggtggcatcgggcggcattattggagatccactccccgccccaacttaaattcccgctaagcagccttggcgtaacttattcttttgagaactttgcacgtcttgagggaaccccgtggggagggaggtagggtgcagcctcctaactactcacgccccccaaatagcacatatttggatttttaaactcagagaagaacacatatttttacatcattacctcttaaaattgtccccagggcttgagcaagcaaaccccgagtcctaccgggctgtctcacttccacggccccgtggacacctttgcgaaggggaggcggagctgccgaggccgcgggaggggaggggagcgccagctcgcagctccgtgtcagcccctcagccctgtgctctgggccagtattcaaggtgtgaggaggtgactgcagcaccatccccaggcccacaccaccgtccgttcggcacacctggaaacatctcagagtggcgagtgtggaccgacacaggggcagcctacacgtttcgcggtttagaagccaaccgtgtcaaacaccagctacgcaggttccttgctggtgggtgaggcccagagctcctggcagggacccaggccctcaccagggccttcttgcaaacggggcgcctggctatgatcctcccttcaggcatcggctggcttcggaggcccatgagggtcccaggcctgccctcctctcacccctcccgcccttggctgtgcccggctggagcccccacagctccgccccagcagcgcaaggccttcccagcagccctgggtgggttacgggtgtggacctggagtgctccccacttccacccttagcgttccgagcacagggcagcgggaggcaggaggcccggcccggtccctgctgccggtggaaggaaaatgaatcttgggccctgaatcactgagctaaggggaggagtaaggctgggaatgtgtcagacaaacctgcctcccatcctcttcctaaacaagagctgcagagataaacggccacaggcctccctcatcattcacccacgaggaaattccttgtgagccttaagatctctgccctaagcagttttgtggagtttcacgctgggaatgcacgtggacagctgaccgtcaacaggcgcaggacagggacagagatcacggtcctccctctgctcacctgagacaagtgtgtccgacagctccctctgggctgctcatgaaaaaccgcagtcacggagccggacgaggatacaagtgactctccctctagtcccctcacgtgtaaattgtgtgttcagtgaaaggctgatcgagacccaaagaatgcagccctgtgtctcctctacctacgacctggaagcccctcctgcttcaggctgtccctttccggacagaaccgacgtaccccctcacaggtgctgattgatgccccacgcccccctgcaatgtatgacgtcaggccgtgccccgccttggacacacgtcgttggacctcctggggctgtctcggcgcatccctaaccttgggaacttcctagaactttctaactgggctgggctctgacgcaggtactttgggttcagtgcctggtgggacagccgcgccgtccacccgctccccgcggccccacagcccctacccagctccttgtgaggcttcctagggcggctgggagggtccccctcgggctgcaggcctcccagactcctgcttcgctgaagttcagaggcctcactggccgccttgaggtgcccaagggccactcctgagggcagggccctgaggccgggccggtgcctcctgtgtgtggtccccgtgtccttctccatcctccagcccagcctcggcttgagcacaaggctgccaccctcacacccagccgtcccgcagggagtagtcaggaggtgctgggagtgcgttgccatgggtctgctgtgacatcactgtaaggtcagaggccaaagatcagccgatccctggcagcacagcgtggctttcctgcaggccggggctggggcgggttctgcgtcttcccttcttctttcccgcaggccggggctggggcgggttctgcgtcttcccttcttctttcccgcaggccggggttggggcgggttctgcgtcttcccttcttctttcccgcaggccggggctggggcgggttctgcgtcttcccttcttctttcccgcaggccggggttggggcgggttctgcgtcttcccttcttctttcccgcaggccggggctggggcgggttctgcgtcttcccttcttctttcccgcaggccggggctggggcgggttctgcgttttcacatctctggtctctccaccagggagggcggggaactggcaccagccctagcagggcctgcagatgagacgccggtctccctctgtgacagggtatttgaatctttctctccctatcagggcaaatgggacacagatcaactcaggaagacaaaggcagcccctgcaggcagtggtggggtgcaaatgctgccggcccagcgcctctccccacccacacggcgccaggacgaaaccctgatgtggccggggctccggcgagggctttccgggccgacggtgtgaactgcacaggtcagcgtgggtttgctggcactcccaggcaggcggcttaaacagcgggagctcattccctccggtgctgggggcaaggtgtctcgcagcgctggttacccgaggcctctctccttggcgcgaagatgacgtattccgtgtcctcacgtggtggtcctgtgtgctgcgtcctcgtctccccttctcatgaggacgctggtcacactgggtcagggcctcgctttaccttgacaatctctacagctccacgcccaagtgcagccacaccctgaggtcctgagggtcacagggtcacagctccagcatgaggatttgccgggacagagttcagcctgtactgagccgaacagaaaatccccggcacgctgtctcctccagcctccagaccacggtgggtggggaggcaacattttacctcttggggttttttggtcgggcctgataattaaaatcagcagatgagctggagaaaggcacacgcactccagcacggtctgtgtggccgggaatggcctttccttcctgaaagaggaggtaacaccccacggggaagacgctctccagagccagaagaaagcagcgttcttatccttgtggatggctgtttcagctcaaaacaacccttacaacagtgtggcttatttgggcagccccttctgccccttgacaggcacctcgcgagccggcgcacccccccgcccccaggacccgcttcccgcacccggggctcctcagccagggggaagcaggtgtgacccccaggctgcaggctcccctccttctgatctcttcttttgaagagcccacagcctctcagcacccaggaggcctcagctctctgggcaagtggtgggtgcagggtgggggccttggcctcacacacgctctggcactgcctggcctcctgggacggttcctcagaggcacctgctttggacactctgatgtcgggagccccgcggatgctgccaggatgggagaggaggccgctgtctctctccaacaagtgctgggtcgtctggagcaacaagggcaaatgggcgtcactggggtctccacaaagccacctgcagtctcttggtgggtgtattagacagtttccatgctgctgataaagacatacctgagactgggtaatttataaagaagaggttgaatggattcagttccacatggctggggaggccctgcgatcatggtggaaggtgaaaggcacgtcttacatggcagcagcaggagagaatgagaccaagcaaaaggagaaaccctcataaaactttcacatcggatctcgtgggacttataccacgagaacagtatgggggaaccgccccatgattcaatcacctcccaccaagtcccacccaccacacagattcaatcacctcccaccgggtcccgcccaccacacagattcaatcacctcccactgggtcccgcccaccacacagattcaatcacctcccaccgggtcccgcccaccacacagattcaatcacctcccaccgggtcccgcccaccacacagattcaatcacctcccaccgggtcccgcccacaacacagattcaatcacctcccaccacacagattcaatcacctcccaccacacagattcaatcacctcccaccacacagattcaatcacctcccaccgggtcccgcccaccacacagattcaatcacctcccaccgggtcccgcccacaacacagattcaatcacctcccaccacatagattcaatcacctcccaccacacagattcaatcacctcccactgggtcccacccaccacacatgggaattatgggagctgcaactgaagatgaggtttgggtggggacacagccaaaccatatcagtggagacgcgcaggggcttccggcccccatacactcccacctcccactgccctgtaggactctcctggctgttccagaaggggcttccattctccacgttccctggggcctcgtcctccttgcccttctacttcctcttggaggggctgaccttggccctcctgggctgaccccagcacagctgtgcccagagtgtgaacggagccccctggctcccgacactgcctgaggccctgccgggaagtgtggctccaggaggacgggctggcctcccggggaggatgcccccacctgcaagggtttgtccaccacccatagccactcctggactggggcagaccccacacctcagcatggactaaggaggccggccaggctgaaccaagcctcacccttccctgggagaaaggcctgggttggtgtccccaaagccacacctcctcatttttctcataccagagctgactcacaatagaattaccaaaaaagaggaattcaaatggagcaaggaaaggaataaagaaatgaggcaacgtatcatggagtcttcacccagagccccccttaaccctctcctgcctggagggacagcagccacctgcctagaggcgcagtccgttctcttctcccagggcctccaagtggcctccccctctgcattcctggagatggcagcacgtggtggtctgtctgcccagcactccttgagtggacacacctttcctgaggttatcacagggccggactctcacctgaggcaccacaggtgaatgccactgtcagagcagcgctgcccatcaccaaagatgtcaactgtcaccagtgatgtcacctgtcatcagggcggtgccacctgtcagagcagcgctgcccgtcatgaggcgtcaactgtcaccagcgatgtcacctgtcacctgtcagagcagcgctgcctgtcaccagagatgtcacttggcatcagcaatgtgacctgtcatcagggcagtgccacctgtcagagcagcatcacccatcaccagggacgtcacttggcatcagcaatgtcatcctgctccccaggtgccaccctcctccctgtaccccccacccctaatgcccacatgtgcaattcccagtgggtaccactggaaaaccaaggcagtcctcagaaagaataaaacatctgttttaattggccagtaaaatacattgcaaatcattagtattttataaacagaaacattaagttataaatccatgttaaaaattgcagctcagtgcagccccaacagctgtgtgtccaaaagtctatttttacaacattttcctccagtatttttgtgacaagaaagttcctatctgccatctagatcaagagcctgaactacagtattttcaaacaagaaccgggagaagtcggtacaaggatacgtcgtgctgtgtatttaaacggcgcttcccacacacctgccgtctgcatcccgggaggacgccctttgggaaaggcctcctcggcagtgtgaggtctggaggggtctgcctggaccccatttttaggatgctcccctccccaataaaacagcagcccccgcccctgccctgcacagcatctgggggttcataacacaggtgcaatactgaccatgggccctggagggacgtctgcaccccgaagcccctgtacctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacatttctatttttaaaatcttcaaacttccacggggggtggcaaatgttaattctgattttaaaccccattcaacagcaaaacgatgtgggcttcaactgtgggctccgcagacgcctggagaagctggagcccacacctttccctccaagggactctgtggacagaacccgtatcccccaagcaccaaggacatcctcagactgggacttctgtgtaattctgcacctcccagccataaaactgacccctcagccaggaatcaaacgaacctcgaaagtggaacagggaggccgcctcccatggctgcctggatggcaggcacagtgggagagtaatgctctgaacctcccaatgtgatgaagccgaaagccgaggcggggccagcaggcctcccgggcacagagccacagagcccagcgtcacacgcaccgtgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtgcacatctgcactgcaaagagtgtgctcatgtgtggggagcatgagctccagggacacagatctgtcccagtgctgggacactcagcaggcgtgggcacctcctccccacatgcacacctccctcataccatgtgtgtgcacctcctgccatgtgtgtccactacctccatgtgtgtgcacctcctcctacgtgcctaccacctccatgtgtgcatctcctcccacgtgtgtgcacctccttccacgtgtacctcctcccatgtgtgtgcacccctccgtgtgtacacctcccacgtgtgcacctgtgtgtgcacctctgtgtgcctcctgtgtgcacctcctcccatgtgtgtgcaccacctcccacgtgtgtgcacccctctcgcatgtgtgcacctcctctgtgtgtacctcctgccacgtgtgtgcacacctcctcccacgtgtgtgcacctcctcccacgtgtgtgcaccacctcctcccatgtgtgtgcacctcctgctgtgtgcgcctcctccatgtgtgccttctcccacatgtgcgcacctcctcccacgtgtgcaccttctgccatgtatgtgcacctcctccgtctgtgccttctcccacatgtgtgcacctcctgccatgtgtgtgcgcctcctccgtgtgtgtgcctcctcccacgtgtgcaccacctcctcccacgtgttcacctcctccgtgtgtgcacctcctgccatgtgtgtgcacctccacccatgtgtgtgcacctcctgccatgtgtgtgcatcttgtaccatgtgtgcctcgtgtgcgccttctactacaacaaacagcatcatgcttcgcgcattttcaacctgctggcttttggccatgaggttgatggacctgctgatatcaacgaggcaacatatttggaaggcaaatggggctgtctccccagaagggtgtcgagagggatctgatatgatgatgtcagaggtgaagtcacagcactcaggaggtgttgcaggctcagtcccctgagcaactcggtccaagtccgggccacagggacctgtcactctcctggagcctcaccactgcccttcccagaccagacccgcatggtggaaggaaggaggggttaagaaggaaggaagggaaggagggagaagaagggtggaggaggagagagggaggatcgaagggagggaggaccaaagagaggagtgagcaggaggatggaagtgaggaggaggctgtacagctacacagggctctagggcttacccgcccctgaatgagcccgtgtgggggcttctgccatggtggacctgggtacccactggatggagagagtgacacagacacatctgctcactccaggctaagagccagcctagcactttacatagtttaagtcaatcttccagcaactcatgagggtcttacaaccctctgttccatggagtgagggggagtggagcttagctaagcgccacctagcctgcagctggtgactaagctgaacgtactcaacctcgccacacctgcctcatgagacaagagtgggtttcgtccagagctggccctgctcccgggcaccatgggtggcctggagagatgccagagggtgtgccactgaaccaaggcagaacaagacctgggcctagagactgccagagcacgtgacaccagtatagcagagaggctgggaggaagcaggtcagggaggcagcccggacgctggctgggggcctggagagcaaaggcagcacctgctctgaaggagggaccagcagcgccgggccacgtccactgactaccgccaggtgccagcccggtgcaagtgggactctcctcccaggcggacacctgagcacgggcggccccacccgggagctccctgcagccccacccccactgcaatctcccgcccactacactggccgtccagggcaggcacgggagtggcactcactggcttccatatttcgtcttcttgaacttgtccctcttatactgggcgtgctcctgctccaaagccccaaccccagcgatgacttgctttagcgtcttgtaggtctcctgggggtcgtcaatgacgaacgtcgaatactcctcctgctccgggccgtcatacacagatttgctcccacaggcctctgtggagggcggaggggtcagcgcagggcaggagcccaggccaccggccccgtctccacacagctgcgtcgctgcaggccccacccacagtacacatccttccaacgcaagctcctccagaaagggctgaccaccactcgtaaacgcagacggagatagaaaccattcccgcaggtaggcgagttgtgcccacactgagcccagggaaagcccattgggagctggatgctgagcaacctcattcacctctgagggctctgctgcccctagctcccagccttgtcaccaatcagccattctcacagggggatgtgcacatctctgcacgccccaccagcccgcccagccagaaccaggaggagagacacctgcagctggacgctgggctggctcatgggccctggggcagccctgaagagtcagctgagggagtgagcacgatggggttcagcacatttcacacccagctgccactgagcatgtccagccaggacaggcctagcccagggctggccgagcacagggcggacaccagtctgtgccgcagcttctaaagaccactgccccggaccccacctacgcaccggggccaccttcctaatcggaccacatcactcctgctgaaggccattctggtgcctcgcccctagcggacagccatggaacccttgagccagggcagggccctgtgccacctgagtccaaacacctgaaccaggtacacgtctctgcctcactgctcacagcgcctgggcacgcactcccggagccagcaccgatgccctgcagctgtgtccatctggatggaatgaatgtttgtgcccccaaatctgtgggttgaaatcctaactctcaagggatggcatcaggagatgaggcctttgggaggtgacaaggcgtgagggtggaacccttgtgcaggggatgggcgtccctatagaagacaccaaggaagctggcttgcctcttccacatgtgaggacacaatgagacactggcgggctgcagcccagaagaggacccgcagttaaaccagcactgctacgcccggatctcaagcttctcaggccttcaatctgggaagtgaattcctgctgtctgtaaccacccagcctatggtacaatttttacggcagcccaaactcaccaagaacttggtactgagaagtggctgctgctgtaccttcaaatgtggactggctttggaactgggtgctgggcgaaggctgaaggggtttgggggtgcagagcggaaaaggcatggctgccatgaatgtccttaaaggacaatgctgggggctcgggagaggagagctgcagagaagtcctgtcttaggggatatctaagtaaccctgaacagaatggtggcatgagcatgggtggcaaggctgttctaacaacatctcagacagaaaggacggccatgctactggaccgtggagaaaaagccatcctcgtgacaaagtggacctgtgttcatgccctcgtgttctgggagggtggaactcgcgagtgatgacatcagacacgtaattgaggagatttctaagcaaaatgctgtgggagcggcttggttcctcctgaccgctgacagcaaaatgtggggagagagatgatttgaaggtggaattgttgagcaaaaaggaaccagaactcaaaggctggttgagttaaaagatttgagaattaaaattccagcctacccatatctcaaaaaaaatgagacagcatgtttggaagagaccattaagcaggtggctgtgtggctatctgataaggagacaagtgtggggctgagccttggacttgaccaaccatctcagcaacagccgggagcagagaaggaaccgcaccagcagaggcactgccagaagaaaccaggaaacagagaaaacaggatgaaatgaaggcaggctgcggtgtcttaagccctacaagccaggccatagagctattcagctgtgaacatgtgccattcttcaagacgagggaagaaggaccctgaagcgggtagggccatcagaatgccactctcacccagaatgagtccatggaccatgtatcagatgcaaaattctcagctggaatattgattaaaaaataaaactggcaataactagaaaaaaaatcgcaataaggaatctgtccacccagccatcactcacccatccgtccatccacccatctgtccatctacccattactcacccatccatccctccacccatcactcacccatccatccatccacccatgactcacccatctgtcgatccacccatcatcactcactcctcggtccatccacccatcactcacccctcagtccatccatcactcacccatctgtccatccatcactcacccatctgtccatccatccattactcacccatctgtccatccacccatcactcatccctcggtccatccacccatcactcaccctatccatccacccatcactcacccatccgtccacctacccatcactcacccatccgtccacccattcatcactcacccatctgtcaatccacccatcactcacccctttgtccatgaactcaacactcatccatctgtccatccacccatcactcacccatccgtccatccacccatcactcacccatccgtccatccacccattactcacccatccatccatccacccatcactcacccacccatccatccatccacccatcactcaccctttggtccatgaacctaacactcacccatctgtccatccacctatcactcacccatccatccatccaccatcactcacccatccttccatccacccatcactcatccatctgtctatccacccatcactcaccctgtccatccatccatcactcacccatctgtccatccacccattactcacccatccatccatccacccatcactgacccacccatccatccatccacccatcactcaccctttggtccatgaacctaacactcacccatctgcccatccacccatcactcaaccatctgttaatccacccatcactcgtccattgctccatccacccatcagtcacccattggtccatctgcccatcactcacccatctgtccatccacccatcactcgcccatctgtccatccacccatcactcaccctgtccgtacacccatcactcaccctgtccgtacacccatcactcacccatcggcccatccacccatcactcacccatctgtcagtccacccatcactcacccatctgtccatcaccatcactcacccatctgtcagtccaccgatcactcacccatctgtccatcaccatcactcacccatctgtccatccacccatcactcaaccctcggtccatcctctcatcactcaccctgtcctccacccatcactcacccatctgttcatccacccatctacccatccatccatccacccatctctcacccatctgtccatccacccatcactcacccatccgtccatccacccattactcacccatctgttcatccacccatcactcacccatccttccatccacccatctctcaccatctgtccatccacccatcactcacccatccgtccatccatcactcacccatccttccatccacccatctctcacccatccgtccatccacccgtcactcacccatctgtccatccaccatcactcacccatgcttccatccacccatcactcacccatccgtccatccaccatcactcacccatccttccatccacccatcactcatccatctatccacccatcactcaccccagtccatcctctcatcactcaccctgtccatccatccatcactcacccatctgtccatccacccatctacccatccatccatccatccacccgtcactcacccatccttccatccacccatctctcacccaaccgtccatccacccatctacccacccactcagctgcctgccccgccatctgtccagcacacccatccaggtgctaggcacttcctctgtgccaggcccaggaaggtcactgcatatggaagctgaggagatgggagatggttgtgactttggtgacacaggtgagcccaggtgatgtggtttggatttgtgtccccacccaaatctcaggtcagactgtaatccctagtgttggaggaggggcctggaggaaggagaggggatcatggggacagacttccccattgctgttctcgtgatagtgagttctcacgaggtctggttgtttggacgtgtgtggcatctacccccatctctctctcttgctcctgcatgtaggaggtgcctccttccttcctctttgccctcccaccatgatcgaaagtttcctgaggcctccccaaccatgcttcctgtacagcctgcagaactgtgagtcaatcaatcttcttttctttatagcaacatgagaactaatacaccaggctatggggatggtgaggttgggaagcgcctggaggaagacacttccaaggtaaacagggtctgccagcctgatgcgcaagggtgttcccagcagaggaagagctggagctgtgatgcggggcgcacggcctaggaggagctgagcaaggttggacagtggtgcagggagcaagctgatcatggagggcctggtcagcatctttcagaacctgggtcttgtgtgtgatgacctcaccctctccgaggctccctgactctggcctctgctgtgtcggttcctgctatgagagggctgggaagaggctggctgatgccagacccactgtcttggccaccctgaggccttgtgccatcttcacagtatccagggacctcagacccagggacagcacctcgcacacttgctgggggagaagacgctgtggtgggtggtggcccatgagtgtgtacatgtgtggttgtctgcacatgtgtgtgcatgcctgcacatgggcctgcacatgtgagcgtgttgtgttcaactgcacatgtgtgcaggtattgttgccttgcctgtctgcacacacatgtacctgtatgttcatttcacacatgtattgctgggaacatgtgtgtacatggctatgcatacatgtgtatgtgcctgtgtgttagtgtaggcctggaacccacgtacacccagggcatgtggggctggagaacaggcgtggccaagctcacagatgggcagctgcacggacacccagggcatgtggggctggagatcaggcgtggccaagctcacagatgggcagctgtgcggacacccagggcatgtggggctggagaacaggcgtggccaagctcacagatgggcagctgcacggacacccagggcatgtggggctggagatcaggcgtggccaagctcacagatgggcagctgtgcggacacccagggcatgcggggctggagaacaggcgtggccaagctcacagatgggcagctgcgcggacacccagggcgtgtggggctggagaacaggcgtggccaagctcacagatgggcagctgcatggacactcaggcaggactcatgtgtttccaggccaaggcacacttgacacttctgggttaaatcaggggaatgaaaagaagaaaatctaacaggcataactccaggcacattccgctctatttccattctgagtgggactcaagggccctgtcatatgatctccaagagcagatccgagttctaccagacactggcatagaaacaaacgcagctgcttcacccccgtgggcttttcttgtctctgcctctcctgaatcacagacctcaaaccactgtccccatgtggtctaactgggcttatctggattgctatttcaattctgtaaagcaattcaatgtcacagataatgatacatactgcatatagatttgaaacacacggtgtgcctggcactgtttcaaatatatatgcagtatcgttatctgtgacattgaattgctttacagaattagatggcatgtgtgtacccacatatatgcatgctgacacatgtgcccaaagacatacatgcatactcacacgtgccctcatgtttccacacatgcacaaattcatgcatgctcacgtgtccccacacacacatgctcacacatgtacccacacattcactctcatacatgtcatgtccatacattcacacacactcacacacgtccattcatgcactcacacgtgtccacacattcacacatgctcacacatgtccacattcacacatccacactcatacatgtcatgtccacacattcacacacgctcacacatgtccacattcacacgctcacacatgcctacacatatgcacacatctcatacgtgtgtccgcacacatgcaagcacactcacatacgtgtccacacacatgcacttatccctctggaaaacaaaggaatgaaaaaataggtcctctaaagaaacttggcagtacagaggttacaagttaaattccatctaaaaattatctatagaacctattatacaggtaattgtcccccagatagctgcctaccctgcaaaaagcttttcgcatccatccgtgctacaaagacaactacatgtagcccacactacaccagaggctcagaccacaggttttcaccccacagcatgctcctgaggccggggcctcgccagccatcccctcgctgcacagatctgtgtgccgggcagactcaccctgcatcttctccagcttgctcatgtacaagttgaagagggagtagatacgctccgtctcacggtccccatcaatgtccagctggatgttggctgggaggccgctgtccagacacagcaagaacagaaagataaaaacacttatttaaacgatgcttttaataatgacattcatttttaaaatgtcactgaagaaagacaacgattgtgttggaagtgaaattcgacaggatcgatttgctgtccgtctgtgcacagccggtgtgttggcttgctgagcaaggctgacagcgtccacagcagcacggacagcagtgtcaccaggctgcaaaccggaactaactagcaacctctgcttcagttaccattggcctatttggacacgtggcaaaagatccttgctgtttagtatttaaaatgtgcttatcatttgtactaactgacctttcctgaaatcacgcagtactgagttatgtcttgtttaaatctattcctactccagaatcttatcaatacataagaaatttaggaagactaggtgctaaaatccccagtgtaatatgtaatacttgtacatttttagtatcatacagaactcaattcccaggaactatgaacactccagacctcatgtggtttattccttcagtcatttcaaacacagaaggaggctgtgtgcttgtttccctgctcattctatgtctgcttctcctatgttcacaccagcacacgtcaggctggagcgcggtggcacgatctcagctcactgaaacctacgctttctgggtttaagcgattctcttgcctcagcctcctgagtagctgggattataggcacacaccaccacgcctggctaatttttgtatttttagtagagatggggtttcaccatgttggccaggctggtcttgaactcctgagctcaggtgatccacccacctcgacctcccaaagtgctaggattacaggcgtgagccactgagcccggcctcatgtctttttataaatcttactttgtgttattatgaaaaacctccatagccgggtgtggtggctcacacctgtagtccccacacttttgggaggccgaggcaggtggatcatctgaagtcaggagttcaagaccatcctggccaacatggtgagaccctgtctctattaaaaatacaaaaattagccaggtgtggtggtgcacacctataatcccagctgcctgggaggctgaggcaggagaatcgcttgaacctggaaggtggaggttgcagtgagccgaaatcacaccactgcacttcagcctgggcaacagagcgagactctgcctaaaaaaaaaaaaaaaaaaaaaaaaagaaaagaaaagaaaatctacattgtacagaagcacgtctttgatggcttcagacaaagtggcctcacggttaatttcacatttgcacgcaggtgcaaccaacagggagggcctgataggaacgcgcggggctgttatttttagcaaaatgctgccttgtgcagaacgtgtgaaatatgctctttaatttagtaaatactttttaaaaggcagaaatgcttattatagctaaaacaattcttaaatcataaaatttctgaaacgtctgtaattttttccatactgattagaaattgtttccaacttatttttgtttgaagtatgacagtttttcccttttcttcccaacttctcttgtaaaaaaagaagtgggtttctgctaatgaactgatcagatgtcaatactgtatatgccttttgagctgagtagctcagtatttggatacttggtcatttgttttattaggtaattgataaaattgtgtcacttattcatgttcaaccatatatttatgctgtctggggatgggtggttatagttctgtgtgagaaataatttgtcagtcttcaacagcttgtaaaaactttgcagtgagagcttaaacatctaaataaataatgaaatgcatttatcataaaaaaaagaagaaagaagatgaagtgaccaacattaaaacacatccctggccagtcagggagttcatgtgggtaatcccagcactctgggaggccgaggcaagaaggatcgcttgagcccaggagtttgagcaacaccaccctgggcaacatggagagaccctcacagtgagacctggcaacatagtgagaccccgtctctacaaaaaaccaaaatttaatgagctgggctggtggcatcagcctgtaatcccagctacttgggagagtgaagtgggaggactgcttgagcccagaagtttgagaccagtctgggcaacgtggtgaaaccccgtttctacaaaaaaccttaaaacaattagcctggaatggtggagcacacctgtagtcccaggtacctgggaggctgaggtgggaggatggcttgagcctaggaggtcgaggctgcagtgagctgagattgcaccactgtactccagcccgggtgacagaacgagatcccatctcaaagacataaaactaaaaaagcatccccgagctgggagaactgaggctggctgtgggtgtgcgggataggggaggctcccgagctgtccggcctcagcggctggagcctcttgggacccacagatctgccaaggcagtgagcaaactcggcagacgtgttctcatggagataaatggcctggaaggaagcctcctgggactgtgttccctgcacggtcggctgcgggtggggacaggccaggttttctctcctcgtcaggctgcaatgcttcccgctgtcctgggatgcgaggacatgggagagcgctggcctctcctgggggattctggggcggtggccacgcatgcctgagcagcagccaggcccccttcctgagcttcagcctctgtgtccacgaagcaggatctaaggtcccacctctgaggctgtgggaggattaaacggtggcccagcatggagcacagctcatcccctgcagggcccttatgcgaaagcatcacgtggccacaacaacagcgaggtgcatctcacggagcataaccagggggaccgccaggcacccaggcctcctccttaggaccggcagatatgacccaagcctctgtgcaactgccagaggcccggctgatggggggccctgctgatggggggcctgacagggggcccagctgacggggggcccagctgacggaggacccagctgatgggggcccggctgatggggggctggctgacggaggacccagctgatggggggcccggctgacgggggcccggctgacgggggcccggctgacggggggcccggctgacggggggtccggctgatgggggtccggctgacggggggcccggctgacggggggcccggctgacggggggcccggctgatggggaggcccggctgatggggaggcccggctgatgggggacccggctgatggggggcccggctaatgggggggcccggctaatggggggcccggctgatgggggacccggctgatggggaggcccggctgatggggaggcccggctgatgggggacccggctgatgggggggcccggctgatgggggggcccggctgatggggggcccggctgatggggggcccggctgatggggacccggctgatggggggccgggaagacaacgggctgctgcgtcatgtggaatcaaggtgggtgtcctgggccagacgaagctttcagggaggggcttgctcccagcctcctcctagagaagcaggatggccacggcctggggagtcccccttcaccctgacctcccgctcccccggggcagggcctcaggaagaccctcgaaggcctgtggcaccctggagtctgcgcagagccttccagaggctgggccccagatgctccctcgagggaggacccctcgggtgggaggctcctgggaggaggcgagggcagccctgtttatgtgcagcttacaggcaggcatgcactgtctgctggtccctccctactcagccccttggccacatttcctgcacagtgcacgagctgggcaccgaggcacagacctacccagtgcagggcgagcagcccggagccgagtcggatggcgccctacagcacagccagtggccgctcaggtaggcggacgggtggtagacggtgaggcgcttctggttgcactggctcactttggtgagaatgtcgatccagtccttggcctccacgcagttgttggcctggatgtacagcgcacgctctggctggatgacctggaacatctgaggacacaggtgggctcaggacagcgcacatgaggtctcgtggctgagcacgtgcaagagtccaccaggcacctggccgtcctcgccggagtcgtaagaggggacgctgagggtgcacaggcccaaaagtcctggagctctaagccccagaagaggccaaggccagggggtgcatggagctctctgccaccctaaaacctgacagctggggccgtggggaatggaggtgagaactggtgcagctggagatgtggccaggtggccaggaacagcttggccaaggccctttatgtcctggagccttggaggtctccattcaagacaaaagaggggccctgtggcctccccacaaggccctcctgcagctgactgcaggcatcccatccacgtggtgctcgtgctgtgtcagcccaggtggcccggcctgctcagctccttccccaactgaccagcccaggattcttcctcctcctcccagctggggttagggggctgcttcctcttgaagcgtctcggggcagcaacaacctttaccatttattactcattcaacaaacatgactgagcaccagcactctcctatgtcccggagacaaagcctggcatagagtttctactgaacctgcagccaccaagaaagactaaacgagggcaggtgtcagcagaagctggaagtgagcagtcctggtgctgtagtcggcgttgactcaaagttagttaagcagggggtgggggcaaagggtgtcaaaggcagaagaaatgggaggcacaaaggtcctggggcaggtgggacaggggtcctgtgattggagggacaggtctcccggggcaggagtgacagaagccttaggattagagggacgggggtgctggggcaggggggacagatatcctaggattggaggtcagaagctcccagaaggagccggctctgttgcacacagaagacaggttttctgagtaggagactgactggaggttgggagggctctcatgtgggacttgcccttaagtcaggagtcagggggacagtggccttctctaggggacgggccttctgcactcatctggggaggatttgggctccaggtttctggtgaacagctgaggtcttatttacagaggccaggagcctcccgccttgcacccggcacatgtgtataggtctcggactggacgcccccgtgcatggctgtgatcccccatggagggcgtcctggccatcatcccaggctcggccctgccaccaggagcagccttcagaaaggtctccccagctggtgagagcctggcctggcagtggcctcaggggaatcgggctctgaggaagtcagtgggaatgaacagctgggaacaggcggctgaaactagggaattattgggaatctatgtgaagggctggaggtgcttccaggacatgtccacactgcttccttcgagggacggtctcagggccaggttccggccatccccctcagtcagcaggcattgagcccacaccctcctcttcccatctccccctcttcccaacccttctcttcccagccctcctcttcccagccctcctcttcccatgccctcctcttcaaattactctccaaacttatgccttttgcaggatctgtctggactgcctgtgaataacatgctagtaaaattctgccaatggtaaggaacatgcgtcaactttggcacgaggcccagggactgtgccttccctgcaactgttctatgaccctcatgctgcagtcggggcacagaaggcttgtcccagccagcatgtgtcagggtacggggtcagcctcaggatggcacggacggcggggtcactggctgaaggggcactgagtcaccagggagaacgtggccagcggccgactctgggaggccaccacacaatggtgacgccacggacacctctaggggattcccgccagaaatgcatcatcagaacctgccacgtcggcacatccgacaaacccacagggagggatgtccagaaaaccgaaggcctgcacgcctcaaagatgccaaggccaccacacacaaagaaaggctgggagtgtccagtgggccagacggagggggcagcagaatgcagcgcagactggatccagaggggaaggaaccacagccggaagaacgggactggacagcggcaaactcgaatgtggtcgcgccggcgacgtgcgatggtggctgctgtggttttggggactgcacggtgggaaacacacttggaagtgttgatacattcagaaaagcacgggcgggaccgtgaagggagaaggaacaagtgtgactggggaacgaggcgacatgtgggtccgggtcaagcgtgaccggggaacgaggccacacgtgggcccgggtcaagcgtgaccggggaacgaggccacacacgggtctgggtcaagggtgtgtggaaagtacttgttctactcgtgcaacttctataaattcaaaattatatcaaaataaaaaagcttccaaaaggaattccagacggtcccaagcctgcttctgggatgtctttgacagagggccccttgacattggggaccctgcgggggacgccacctgaagcagctcaggccccaccttccggcaggttccaccccaccccggtgaccccgggcacagagagtgtggctgctttgatgcgagattccgacacaaactcaccagcacctggtgaacaacccgagtaacacgaagactctgagaagcctggagtgcagtgggtggggaagggtgagcccagggccaggtacgggaagagagcagagaaaacctggccaggcctcaacccgaaagagaggcttgggggccccacactcacgtttttcattttgaaagactcctcctccagcttctccactgccaggatgttctcgatgggaatgctgtagagaggctggtcccctgcagcagagatggactgtcagtgggtgcgggccccgctgtcccggctggggtccgggtggggctgaggggtctctgccggggggtctcccagggggtctttaccggggggtctctgccagggggtctctaccggggggtctctgccagggggtctctgccagggggtctctaccgggggtctctgctgggggggtctctgccagggggtctctgccaggggtctctaccgggggtctctaccggggggggtctctgccagggggtctctgctggggggtctctgctgggggggggtctctgctgggggggtctctgtcaggggatctctaccggggggtctctgctggagggtctctgctagagggtctctgctggggggttctctgctgggggggggtctctgccaggagggtctctgctgggcggtctctgttggggtggtctctgccaggagggtctctgctggggggggtctctgttgggggtgtctctgctgggggtctctgccagctgggggtctctgctggggtgccctgggccggaggaggtgccccatgttcatctccttggggatgatggctgaatcactgacaggctgcaggtgcgggggctgaggaagcctgggacccacctggccctgccatgcacccaggctgggcccaatgctcgcatcctcacagctgccgtggcctcaggctctgtccccagaacatgttcccgttctgggacatgaacatgggagaaactgctagatatttcctaatctagatctgagccagcagatctgacagcgaggggcaggaggtggtgggaagccccgtctacctcggcggagcggcaccctggccatgacgaggcgaccagaggaggaagggacgtggacagaaaagcaccttactgatgtggtcagctctgcgtttactggttctctggggaagcagatttccctcactttccagcagcaggtctgaaagaccccttcagggatctttgaagggagaaccagaagcagagggctctgggtcaccgcggccccgggctctgcccgcagcactgaatccttcctcccctcagctctccccctgaaaaagcagactcagtcccagggcccagcacgctccagcaagagccagggaaagcgaccttgctccttacctttgcttttgtggtaggtaaattcatggttggtcaagcgaaaccatctcttcttaaaattcttcatcccaaagcgcttccgtccttgggccctcttgatcatgaacctgtgtgaagagcacacagggccggggtccgggcctcagctgcctccctgcacaggtgaaaaaccacaccccccactttctgcgttctgagacctgaggcaggcagtggattttcaatatcttatcattttactccgagtgatgagattaaaattggaaggcaatgcctctcctttgaaaagttgagcgctgactgctttgagtcaccagttggtgatggcaccaggttttaggagatctccaaccctcctgcctcccacactgaactttcaacagtggtgctgccactggaaatgccaatgcgatgctcccacggcggacctgcggccgtgggctcagggtcagggagggcagcggacgcccacacaacacggaggacctgcggccgcggacctgggatcagggtgggcagtggacgcccacacaacatggaggacccgcggccgcgggctcggggtcagggcgggcagtggacgctcacacacagaggacctacggccgcgggctcggggtcagggtgggcagtggacactcacgcaacatggaggacctacaggcgcgggctcggggtcagggcaggcagtggacgctcacacacagaggacctacagccgcgggctcagggtcagggcggacagtggatgcccacacaacacagaggacctacggccacaggctcggggtcagggcgggcagtggatgcccacacaacacggaggacctgcggccgtgggctcggggtcagggcaggcagcggacgctcacacacggaggacctgcggccgcgggctcggggtcagagcgggcagcagacgcccatactcagaggacctgcagccacaggcttggggccggggcaggcagcagacgcccacaaaacccacacctgtgttgtgcgggagtcacgcaccagcgcctctgccagaccaaacctgccccctcagggccagccctgctgtggtagaaggcgccactgggccacgtcctcaggaaacgtggggagcaggagacaggatggccaccgaggatgcaaggcctcagcgaggaggacctcaagccttgccctgggcagggtcctcgaacaccctcccggcagcccagggccctctgaggctcggccttcattgccgggcaggggtccctgaccagaaccggcggccgagctggaggagaagaaagtggccagacagagtgactggaggacagaggtggaagctgaggacgagaagccaagctggagagacagagtggggaggtgggcgggggagacgcacctcgacaagcgcactcagaaatcggaaagaggggctttgagcagcaacacagccagatgtggccagagagctgtggacgcacaccggagggtgtggaagctgctgggagctgttcaagagagaaaagggcggggcgctgggagccgccaggacagcgcagttcacaaccagtggatgccgaacgccgttcattccagggattcacaggcaggaagtcagcccaggaggctgttgaggaccagcaggacccagtgggatgcgcagggcggggcctacacagacgggggttggggggggactgggagctccacgacatgccggcctccttgagggcaacagggcgcctctgagaagactctggaccatgtagcagttagatttgagtagcagtcttgttataaatgttttcggctttaggatttttttaagaaccccaactttctgagggccttcagtggatgaggctgcatgtgaattttatgtgcagtttccaggttaaggcagcactgagtggagagaagccagtggctcctcactgcacagctctggtctgggcgcctggctctccaggagtcggttttctaaccgggcccatcgcgcgtgtgggacggggaggcaggagccacggctaagccggaagcctcaggctgaaagcagctcggccccgcgcagccacggccaactcaactcagcaaacacacgctgcgctgcagaggccccgtccccagtcctgtgtcccagtgggtgaggacacacacagccctgagagacggcagaggtgtgggagcatctcagcacagggtgagccctcaggaaacatggtcatcaccacccccacacatggacgaacatggcaagacacacttggcaccaagggctgagatggcagaaccgaggccctaggacggcccatgcttgcacaaccgagggtggccctaggtttggggatgtgacagagctgaggtgccggaggagaagctgatccaggggctggaaactcgagggcctgatggaccaaaaccttggtgtgagtcgcaggtggtgcagctgctggaaggagctggtggagcctcagctgcatccagggcacctgggaggcgcctgtccttgaacctctggctggtggcacctgggaggcgcctgtccttgaacctgtatctacagcagcttctcggcgtcagacacacaagccctgagtgtcctgtgttgctttagggattacaggatgaatatctgttgctttgaaagctgtgaatttatgaaatgtagaaagtaaaaagtttcctcttcaaagtttcccttcttgttaaagaataaatcataagtgttagaaataatagtttcttttaaagactaacttccttcaagcctccttgctttgtgctaataactctttgttaagctctatcctgtgtagctgttggacgtgcccacaggctcgtaatatattctgtgtccttgtaccttaaccaaggcaattgtgttagacgtactcataggcatgtcccagctcacagcctatgccccttccttatttaaacatattattatttttctacctatttaaaaaagttttaaattattagccaatcaggtcttaatttagattgtgaggtccggctccaggcaatggggacaggacacgacaacaggaacctcgtgcgtaaggaataaatattctggcgtctctttattctgtgtgtgcccttgccattactccttctgccagggacaccctttctgcagaaagtaaaaattgcctcgctgaaagaactttttgtctaaatgctaatttttccttatggcaccgaagaacaaacattttgcatttctaacatgaaatgtgtgtattgcaaatgttattggttaatatatgattaagttaaatgaaggtgattttaagaaaaatagcaatgtaagtaatgccactggggtatggtccaccagtgacccagagatgatccaggtttcagcagatggctctaacagagtatccacaaaaatagacaaatgggacttaattaaactaaacagcttctgcacagcaaaataaataaccaacagagcaaacagacgacctgcagaatgggaggatatttgcaaagcacagatccaacaggggactaacagccacaatttagaaggaactcaaacaacttaacaaaaaaaataaaaattaaaaaaaaatttaaaagtggccaaaggacagggggatagacgtttttcagaagacaaatggccaacaagcatacgatataaagcccagcgtggctcatcacctgaggaatgagagccagagctgcctgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatggaaattagcgcttaaggaaacccacggagatttctcaagaagctaaaggcagagctgccattcgatccagcaatcccacaccaggccccacccaaaggaagagcaattaccaaaaagacacctgcatgcgtacgtttaccgctgaaccactcacaacagcaaagacacggaatccacgtgtccaccaacggacgactggataaagaaaacgtggcataaatacaccacgacatgctactccaccatcaagaggaaggaaatcttatgttttccagcaacgtgaacggaactagaggttgttatcttaagggagatgactcagagacgaaaagccaaacgccccatgttctcactggtccataggagataaacacggaggggcggggcgctctgggacacgtattcggaatcacagactgaggcctcggaagggtggaggtgggagcgggagaggaatgagaaattactcagtgggcacaaagtgcccgttcaggtgacggtttcacgagaagccccatccaatacaactgcacttgtgcccgacatgttggcaaacacataaaaaatacaggaacatggtccacaccaggcagagcaaagccccgagcgggagtgggagccgggccacaggacggggttggtggaaacgggcagacgtgtcagttatgtaaggaaggttgatgggctctgatgctccagggacctctgggtggaggttgagggaggacaggcctgtgtcagaaacacggggtggctgtgggacacagacgtccccctccaaggtcaccgagaaggtggcagaggggtcccaggctgaaggcgcaggggccagacccccagggctgtcccctctgactctggttccctgagcaaagagccctcgggagcctggagggaaggccagccccaagtgcgggtgtggacaacacggccagtggtacagaaatcacaaggctgctggccagcaagggaggaggctgcccccgactagggaatcttctggaatgtgctgggtgctctggggactgggggcccccatccctttctcccctccggccctgccggatgccaccttacccttctcccccctcctgccctgccggacaccaccttacccttctcccctcctgccctgccggacgccaccttacccttctcccctcctgccctgccggacaccaccttacccttctcccccctcctgccctgccggacgccaccttacccttctccccactcctgccctgctggatgccaccttacccttctcccctcctgccctgccggacgccaccttacccttctcccctcctgccctgccggacgccaccttacccttctcccccctcctgccctgccggacgccaccttacccttctcccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctccccactcctgccctgccggacaccaccttacccttctccccactcctgccctgccggatgccaccttacccttctcccctcctgccctgctggacaccaccttacccttctccccactcctgccctgccggacaccaccttacccttctcccctcctgccctgccggacgccaccttacccttctcccctcctgccctgccggacgccaccttacccttctcccccctcctgccctgccgcccccctcctgccctgccggacaccaccttacccttctcccctcctgccctgccggacgccaccttacccttctcccccctcctgccctgccggacgccaccttacccttctcccctcctgccctgctggacgccaccttacccttctcccctcctgccctgccggacaccaccttacccttctcccctcctgccctgctggacaccaccttacccttctcccctcctgccctgccagacgccaccttaccctccttacccttctttaagcacgatgggctgctcaacactcttggggtctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcaccgcatcagcatatttctgctcattgaagaattcataaaatgtagccatgtaggactccttaaaactcgcctaaaatgaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagacctgccagtgcccgtgaggtctccaagcaccctttggcatcagtgactccgtcctggccccgggctgtccctcacacctgggtcccaggctcatgaagaggtacgttggggcccagatgtggctgcctgggaacctggagtcataggccagggtcccagagcccccacgcccatctctcgcccgtggggcataagggccgctctgaggtgggaagagggggcagggacctccatcacacggggaagtggaggcacccagggattcgggggggcctttgcagccaccattcctgaggctcgaccccaagttcctgttgtttccacactgaggtcactgcacagttccctggctgtgaaatgaggtgggtttggtgcagacctcggaggaggctcaagtgcctgttatggagtttccagcccacagcgcagggcctggctggtgggaaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagatgcctgagggactcctgacctggtggcaccagatccagtctgaagggacgaggatggaggacggaggttcatatccacagggagagaggggccctgggaggagggggccgcgtggggaggggagcgccacgttgggaggaggcggccgcttggggaggaagcgccacgtggggaggaggcggctgcgtggggagggaagtggggaggagggggctgcatggggaggtagtgcagcatggggaggagggggccatgtgaggaggagggggccgcgtggggaggtggggaggagggggccgcgtggggaggagggggccgcgaggggagtagggggctgcgtgacgaggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggggttcactttaggaggggagaggtgagcgggacggggacgctcaggtcctgggtttcaagagaggatgtggtgccggctttgattcttgatctttatcttacgactctctcaaatgtgggaggtttttcacgtgtattttctgaagagagaaaagaatcagttgtccctaaaaagagaaaatgaagaagagggactcacagatttggacttggacaggctgccgagggtctgaacggtcttggagatcaatgtcagcgtcctggacgtctgggggtcctggggaggcgggagcaagaaaggtctatgtcagcatcacagaaatgctgtgactgtcccagatcgaggggacgaaatgcaggagtcacctcagagctgctgtggcttgtgcatgagctacggagaaacaggggtagcgacgcagatgggactggagggggtgggcgtcccacagtctcaggagctgctgagaccatcccgcaggcaacatccgacggcaccgcggtgacccactctctcggcccagcgtgcagggtgcatctcaaagtcgaaagcatcaggtggggtcatggctctggggcgctgagtctcggggtgctgagtctcctggccctgcctggggctcatctcagccttcacagggtttgaaggttcaactcagaagtgctgggggccgggcttggtggctcacgcctgtaatcccagcacttcgggaggccgaggcaggtagatcacttgaggtcaggagttcgagaccagcctggccaacatggtaaaaccccatctctaataaaaatacaaaattagctgggcgtggtggcgcacgtctgtaatccaagctactagggaggctgacgcacgagaattgcttgaacccaggaggcagaggttgcagtgagctgagatggtaccactgcacgccagcctggtgacagagcaagactctgtctcaaaaaaaaagaagtgctggggaatgggcaatccctcacgtcctctcgccctggccatctccttccagctctgccacccgcacgtgcaacacggtcaccccagatccctgtaccctgagagctgcggccccagcaaccacattggggcctggagaaaatcagtgctaaataggaatctgttgactcaatacacggatgatacgccgatcatcaatactccatatgtgatgggcaggggaggagagcagggcggtgaccagcagctaaaaccctggacaaaccgtccactgcttttgtgacactgtctcgactcccccagaacgtacacagcttaaataggtcggtgaaccacctgcaacgaggacgttccaggacccagcgcatccaccagcactccccacgcaccgtccacacactccacacacactccacacgcactccccattccacacaccttccacactccccgtgcaccgtccacacactccacacacactccccattccacacgtcttccacactccccactccccatgcaccgtccacacacactccccattccaaacgcactccccactcactcattacacacactccccacgcattccacacacactcctcattccatgcacactccccatgcattccacacacactccccattccacacacactcctcattccacgcacactccccactcactcctcattccacacacactccccattccacacgccttccacactccccacacactgtccacgcactccacacactcctcattccacacacactccccattccacacacactccccactcactcattccacacacactccccattccacatgccttccacactccccacgcagtccacgcactccacacactcctcattccacaaacactccccattccacacacactccccactcactcctcattccacacacactccccattccacatgccttccacactccccacgcagtccacgcactccacacactcctcattccacaaacactccccattccacacacactccccactcactcctcattccacacacactccccactcactcctgattcctcacacactccccacgcattccacactccacacggtcggccccctacagccacgcagatgccccaacccaggccggcgtcgcaggacagctcagaaagcctcggtccctcagccggtcactcaccgtgtggtgcggcgtgagctggaagaggttgggggagagaatggcgggcgcaaagaacctcaggaagatgaagctgctcactgcagtgtacctgacgtccgggtcatctgcgggagagagaagcagggtgaccgttttcctcgggcacaatggcctcgtggggacaccatgccccggccccctgagggtccgcagggaagtccagccacagtcctggctctatctccacctgtgtctgtctctctccctctctctgtttccctctctccctctctctgtttccctctctctctccatctctctgtctctccccctttgtctctctccctgtctctctccgtatctctgtctctctctctctccctctatttgtctctctctcatctctctgtctctctccctctctttgtccctctgtctctctccctatctctgtctctctctctctctctccgtctctggctctctccccccctccatctgtctctctctctctccatctctttgtctctctccctctttgtccctctccctgtctctctccctatctctgtctctctctctctctccccctctctctctccgtccgtctgtctctggctctctctctctctctccatctctctgtctctctccctctctgtctctctccctaactccatctctctctccccgtctctttctctccgtctgtctctctctccatctctctgtctctctccctgtctctctccctatctctgtctctctctttttctctctttctctgtctctctctctccgtctctctctccctgtctctatctctctgtctctctctctctctctccgtctcgatctctctctccatctctctccgtctgtctctgtctctctccatctctctctctccgtctctatctctctctccgtctgtctctgcctctctctccgtctgtctctgcctctctctccgtctctccctgtctctctctctctctccttgtctctctctgtctctctccttctgtctctgcctctctctccatctctccctgtttctctccatctctcatcaccaccacacagcgcagcccctttggtgtctcattccacagtggtctgtgctcatctgggtgagaggatgtgttttatctcttcacttccaccttgttcaaagtgggtctggggctgggatgtgcttgggaactgcctcccccagaaccctgggcccctcggccggcgctgtctgactgtctgatgtcctgagaatcaggggtggggacagcgtttgtctcctggggacacagaagcgtggacggctctgcaggaccatggccaccccggggtgtctgcagctgtcccgaggccacaggacacgcaaggaagagaggagccggcagcaaggccctcgctgagcctctcagcgccccatacatagcctgagtcctggcggggtcttgagtatcgcaggtgatgggtgggtgcaggcacccagctcctccctgagggtcggcaaggttgagaagtggggtttgggtgctggatgcccaggtccctaggggatctccggcttgggggtttgaagaaagggcagctcccccaggggtcctgtctcttcgaagacacgggcaggcagagcccccaacaccactctgggccctgccagggtcggccacaaaaagaaaccactgggaaaacccaggggtccacatcaggaaaattcacattccaccccgacaaagcctggccacccttcccggcccccccagagaccactgtggtcgtgaactccagggctgggcccctctagagaccactgcggtggtgatctccagggctggggtcccctggagactactgtggaggtgaactccagggctggggtcccccagagaccactgcggttgtgaactagggaacactggcccgggcacaaaccccggaaaaatccagcatcggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgtgcctgcccaaggcaaagagctctgtcatttacatacagaaatgacgaaacagcacgctctgcaagaagtatcatgtgaagtgactaaaatgttggagcaagttcaacatcagggagttttgctgttttaaaacgcagtacacagctctggggacagcctggggaggcagggaggccatcctgtcctaggaaaagggaggggcaggagccattgcccaagggaaggaggagccggggcggaggcagagctggtcaggattgtccaggggaggcagagcagggtgtgcagggcagaccctccgggggggcagagctggggcatgcagaccggatcactccaggggaggaagagctggccgggaccccccaggggacgcagagcccggcacacaggccaggccaaaggtggtggctgaggcctcccagtagtgcagccagcgtactgcagccgggtgaggcgggtatccccacgcctggtcctgctcccaccccaaccggggtcacggggtgagtcagagcttccaggcagccatcggctgaaaaaccccaagcaggtgactggctttggttggttcatgaacaaaacctaccatgttgttttcaaggttttctccgtctttcaacttcacagggtcgatttcacagggtttgtggctctggcatatctggggagaggtttaagacagggctctgtgagtgggttctgggggcacaggcagggagggtggaaggggtctcaggcctggctgagatgtagaccctgagcctcatccagaaaatgccacgacagctccccgaacccggccactggcacggaggggcacggtgaggccggactgcagggccaccgtggggtggtgtcgtcccgagcctcagctgcaagggggcaaccctgggcctgtgtcactggctgcggagggacaagtgagaggtcaggcgcaaacactaggcacggggcccagtccatggccgcgatcagacgagccgggctctctcagggagcgatgtgcgcccgcgatcagacgaatcgggctttctcaggagtgatgtgcaccagcccacacggactaggcctcacagggctttaataatatttttacttcaaaatgctgccatgattttgcccacagagcaaaccagaatgctatgttcaattttctcacatttgcaaagaacctgtttacaaacccgctcataaacggggggcacagcctggcgggcatcagagggtcaggtgaggagtgggtgtgcgggcatcagagggtcgggtgaggactgggcgtgcagctcaaacatgccacgcagccagggcccaaacacaggggactgcaggacatgtggagaaagaaggtctccctgggaagagccaggcttttcttgcatgttctcctttgtggagtggtggattttcttatgtatagttttaatttgggagaatttggaaggttctggagtacacagggaacatcctcttgataaaagtgaatgaatcagcatccccgtggcgaggccagaggggccgacattcaagcccagctcgtggtctggctggatcccagtgcagtgccctctgttgggggaaatcctccccacgcctcgtgaggctgaggactctcggccccgtgctcacctcctcgatggcgggcttcagggtgacatgcaggtaatgcatccccgccagcttcatggtctcgtcgatgcacttggacgccagtgagtttcctcggaagatggtgttggggtccctgggaaatggcgatggggacagcgtttgtctcctggggacgcggaagtgcagacggagcagagcctggccccgagcacctgcctgtgggctgtgaggtcagtgcacgcccatcagtcggcttcctgacattttacaaggagcacaaccaggccaggtgcttggaggccctggccatggaaccgtcctgtgtcaacactgccagagggaaccgttcggctacctgcgtggccaccagctcaggaggagcctggctggccttcgccctcccgccctctcccctctgcggcctctgcctgtgcagagagttgggcaccagaccctggcagcatccaagggccagcagagaagcaaaccctcctgtcagctacagtggctgcaggtgcagccagatgtttctagaacagggcgtccggaaacagcactaggcaggtcctgagggaagctgtgctccatttttgtgggctcccaaagtgccccagggaggggacctgagctgtcctcgagccccaggagccgtttcccctccccactcactcactctacccgggatttcaaaggcaaatgggactttcaaaaaaaaaaaaaagaatcattaactgggtctgtgaaagaaaacctgaatcaacatggtttctggggacccttgaattccctcaagccctgccccaggacacgtggttctcggcgacgaccttgccatccctgtagcgggtccaggccgctctcccccggggcagggtgggcactcactgggtccgcttcacctccgcgctggcgatggcactgatgaatggcaccaccctgccatagtgtaggaagagccgcaccagcgggacggccgcctcctgcttctcccggcaaacctcgcccaggatgtgggccgcagacgctgacacgggctgcggggaggggtgaggtcagtgccagggcccggggtgcaggaaccccagaggcctgtccccaccttggctggggtctcacttccagccacaatagatacggctctttgctgagacagaaacacacacattcacaaaaacaccaaacttcccatttgctgctgcttggctggacccttggaggggcatctgcacctccttctagcgacccccccatgcagccagctctagggcccctgagccggtagagggactctgatgatggggtccccctcgaacaacccggagagtccttagcatcaccaggctcccacggctctaactgtcgacggaccagtgcccccagcaaaggggtccaggcatctggacgggaaacaggccaggctgggaggcgtgggaaaggccccctcagggagaaggtgccctctggggtgggcccgggtgtagggtggggccccaggcaggtggcacctcctgcccacacccacaggccacggcgtggacaagcacctccacatccgcagacttcaacagcaggtcccgcagagggctgtaatagtcagaagaaaacacgtggtcttccgtgtataccacgttcagccgcagggagcccaggtcgtctggctttaggctcttgctaccattgtcccggggctggaggaagtacctgggtgggagggacacatggaggggaggcatgaggctgcatctgccaaggagcagctctcagggaagcccagctgcctgcttgaggtcgactggtcaggagggtgatcctgtaggacccctcagagtgcagcccctggggactccccaccgaagacccccagcagggctggtcaccggggatccccaggaggcaagtgttggagccaaaggcgcaggagtcaaggggggaaacgcggagggggatgggggtggaacgtggcaggaacgggtttccgggaaccggcacagaagtggtcagtgacccgccctaagacccacacccagcagtgtcagcagcaggtggaaatgaaaattatctcaaccaaagtgtgccgtggctcccgatgtcacggggtgggggccttgggctagtgagcctggcaggccacctgggcacctggtcattgtaagagacgttttctgcccggacattcttccatctttggttctaccccacgcagtcacccaggagccctcttctgctctcatttgtgggccaggcagtctaagctctcaggtgggtggagcctgtgtccgaggccccgcccccatcaggtgggtggagcctgtatccaaggcattagcccccgtcaggtgggtggagcctgtctgcagcattagcagcccggtcaggttggtggagcccgtgtccgagacattagcacccctgtcaggtaggtggagcctgtgtccgaggcattagatcccccctcagatggatagagcctgtgcctgaggcattagcccccgccaggtgggtggagcctgtgtctgagacattggcgcccccgtcaggtgggtggagcctgtgtccgaggcattagcccccctcaggtgggtggagcctgtgtccgaggcattagcagccctgtcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcccccgccaggtgggtggagcctgtgtccgaggcattagcagccctgtcaggtgggtggagcctgtgtccgaggcattagcccccctcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcagccctgtcaggtgggtggagcctgtgtccgaggcattagcaaccccggtcaggtgggtggagcctgtgtctgaggcattagccgccccccatcgccccaggtaggtagagcctgtgtgcgaggcattagcaccctggggctctctggggtatgtggtggctgccttggctaccagggccagggattcattcagcataggaggaagcctaactcagctcagggggcctgtgcccgtgccgtcttcgtagaatcaaaagacacgcgtgtttcacggtttctgggatggaaacctgccctcacacatggcagagggacacatggggtgcgaggccccggcacacagtccacgcctgggagtgcacgcttcccgtgactccgggccctctcaggagctgcctgtcgctaagggacacacatgaactggagataaaatgaaacaatggcctgttccttccaccaaaacaccaagcacctggagacaacaggaaagaaaggcaggaggcagcaacacacaacatgtcctggggtgggttctgggtcagagccgaccactgaggtctagacgtgcagaggggagtagagaaccctgtaatgcgccctcaacaggaggtgctgccgagggcccagaacaagacccggagcgcagccgcggcgcagccctgctgtgtgcgcattctgggctcctgcaccggctgctgatgccctcccctactggtgtcagacctcacgagctgctcgcggctcagggccccgctttcacccaggatcagaccccacgagctgctcacagctcagggtcccactttcgcccaggatcagaccctgcgagctgctcgcggctcagggtcccactttcacccaggatcagaccccgtgagctgctcgtggcttagggccgctttcacccacgttccctgtcttgttttgaggtgccagccattgtgagtccctgctcagtgtgatccctgctgcctctcctcacctgccatttctcacctgctgtggggcagaaactcatcaagccagagctcgtcagagctacatgcaaagtaagagcaggtgggtgctgggcacagccgaggaccagcacatgtggcctctgtgcctttccactcagaggcagcacgtgtttttgtggctctcagagatgcggaagtctgcaggtgcaacatcatcttaccacgcctcgtaggagctggactgccgcaggactttcaacgggatccttagttctcccaggaattcatctccaaacttcaggttactggcattccagaggtcaactctgaaaaacagcatcaggacagctctagctgacggcgggcagcccgtgtggagcaaagatgacaggccacgctttgttcccccaggagcagaatggagcctgcagcgcctcccagagtctccatcaaggctcagcccacagggcacgtttcaaacacgtcagaccagcctgtggctttggaataaagatgagtgtctcccagtggtaatgggcaggcagaggaaggcggaaggccatgggcccggactcagacccaggctcttagataggagggagcctgggcatcgctgcgtgcacccagaagctacatgaccccaggctcttacataggagggagcctgggcgtcgctgcgtgcacccaggagctacatgaccccaggctctgtgccaggagggagccaggcgtcgctctgtgccaggagggagccaggagttgctgtgtgcacccaggagctatgtggctgctgccactctcagctccagcaccatctgtcccctttgcccacaacaggcccagcaccagcagtctgtgcacggcgggcaaatgtagaaccctgtctccatggattgctcatgatctaggggcacaaagtggattcaggggccatgcacaccacagcggggggagaactgtggccacaaaccacagcacggtccacgaatctccgtgactaccgcaggcccagcattgtgaagcttctgctcatgtctaacacagcagcggctcccactaatgttctgtcctagtgtgggatggtacgtgtcccctcagacctggggctgtgaaattctgacagacatacagcatccccggctgcaacaagtctacagggctggtaacccagtccctcatggccaggacccactcataggcctgaaacacctgaagtcatgcgtggccagccctacccacgggcctgaaaccacacagttacacgtggccagccctacccagggggctaaaactcggcaggcctaaccacactgtgggcatcaggggcatccccctggagggagaagattccagaaggctggggattttgttacccttgcgaatcctgcagggaagtggcaccacagaggcactggcatctgggccggggagggctgacaggctgcacaggaacccacagcgcgttcctttcagaaggaacatgaggggaccgctgatctgcccatggacactttaaaaaaatgtgctgagtggccaggcaggcgcatttgcctttaataagggaaatatttaaaacatgttttgtgtgcttttaaaaaatttaataactaggacttcactcctgaattcaaaacttggtgtaaaaagaaaccaacaatggcgcttccttctcttgaaaaaggggctggtgtgagtccctggggaggcagatctgaccgaccacgtcagggacattctatggttcaggaccctgacccctcaggaggtggatctgactgaccacgtcagggacattctatggttcaggatggagacaactatgggggacggatctgaccgataacatcagggacattcctacagttctcaaccacaaaaccacgcctcccagcagccgtagggcctgagccacgcaccggctccacgtgtcccattaagggtccccccagggcagtgttagcccctgggagggagggtgaccagggatttgatggccagcacattctccaaaatgacctaaagaaagcaggtgcatcccaggctcagggacatcccaggctcggggacatcccaggctcggggaacatcccaggctcggggaacatcccaggcttgggggcatcccaggctcagggaacatcccaggctcgggggcatcccaggctcgggggcatcctaggctcggggtctcagggccggctggggagggtcaggagggagccgtttccttccttctctgtccagcatgggaagattcgggggcttcaggggaggctcatctgcctcttcatagggaatggaggcattcgttggtacagaaggaacagaggctacgttcaaaaataaacaggaatccagcttattttcactgggaggagggaacccgccggggtttgtgaagggcacattctgacgcctgccctccccagaactctgagtcagcgggatcgtggggctctctaaatcctgggcctgagatcgcgtcctgacctgcgtgaacccacaagcgatttccccgtttcccgtgggaggcgttgaggagccaggaaagggcggtgggggctccatgggcaaaggctgaagatgcagcttctatgaccatacacaggaaacatgaacccaggacgccaggtgagagtgtttcactcgagtcaaaggggacagggtctccacagaggccacccagccgagagtttcagcagtgccagtgggtcctgctcggtcagggccaggcgtcgtgctgacccgccaggccctgcgacctctgagtgaggcctgaacccatggaaggcggagggcttagaacaagaccttaagaacggctgcagcccccgtcactccaggtggatgaagccttacggccagagggatgcggacctctggctttcgcctcttcgcaggtattgcaaggtgagccctaacaccacccacaggctgtcacttcaactacaacttctaacatcctgttgtgaaaattaccaagaaaatggaaattcatttctatctatgaccctatatttagtaacaaagaacaaaagagctgaggagtttgggtgaaaactgccaagttggggacgcggagcctggttttctcacctgatttcgagcttgtccacgtcttcctcctcaaagtcaaagtgggacttcttgctgtagctacagggccgggtcacctggagtcagacgagagagaaagcgctgagaccgcggtgccaccaggcgggggtatatgcggacctaggccccgggctgccctaccctctgcgcttacccacacaccactcaagggccacaaccaggaaggcgccaggcgggattcgggattcaggcctggcttcctgagtgccagcatttcctactcacggcgcccctggaggggcagacccaggtgagacctgccccaaggctgttcacggccacggccggactctcccagtggctcctgatgggtgccgggctctgggtacctaaatgtccgtcacctgcgcctgctctgggcctgccaccccgtgagggagggagggtcccctctgccgtggagacgaagccagcgccgccctcccgtggccccacctcaaggctctatttgccaacaggaagtgaaacgcgtgaggtctgtggagcctgaacctggccggccccgaacaggccccagcactccagggagggtcagacggtggaaagtcaagacgctgctaccttcctcctgacacctccgcaccgtgggttccttagaacagaaacggagtgaaggcgtgaagggtcgaggctccgggaccgccccccgccagccagcagggcccttgcagcagagcaggaggccgacccacaggctccaggagacagtggttatcacctggagttccgatttaaccaccatcagccgtgcaccaggtcacctgcgtttacaagaagggctccgtcctgcccggcctccctccctgcccccccttctccgggcctcagcagtgatgctggctcaggagctctcagctcgaagttctgatgtaaggcttgacaccaaaatcatgttgctaaaactgcctaacctctgagcttgcacttcctgattggtaaactgaggtgaagatcacgcaggggcagttctctgcttcgggttgagggctgctgacgcctcctccttcctgacctacacaccactgtccaaaaatttgcttccccccaacttccccatctcacaaaactcaggtcaggcaatgcctcctccaggaagcccccagtgcccctgcctcatgccctctctgcagggcaggtcaggcaatgcctcctccaggaagcccccagtgcccctgcctcacgccctctctgcagggcaggtcgggagctattgtaggggcttgtctgtttgcatccctcccatgctggcctggtgtggtggccttggactcctctgttttctgccacatcttatcaccagctgatcaccagcacggtgctggcacctgacacgtgttgagtgaatgaaggcagctcctaccaaatttatgagattatttaatctcatttagagagttaaagggtcttaatgtgtctagttgttatcctggaagaaaatggtacagacgctgcttcccatagaaacggaacatctgttttcctgggtctgctcccagtaggtggctgtctgaccacagcccgcgggggatgtgctccctccccggggctcagcctccagctgggtcagaagcagctgaagccgaaagagacagagtcctggtgaaagaggtctgctaaggaaggggaggagacggagtgaaaggtcacagagcccaaagagcagggccccgcgcgtcccacacagcagcggtcagcgaggtccgggccttccctggagccccacaggtggtgacgcagaccatggttttcagactgtctgtggtcactaaattgctcctgtaggctgagacccacgtctttacagagtgaaacaggagtgcacacagtagaaacagcatgagaacactgcaagcgtgatgagcacccgtgtgtggccgggcagtgggcgagctctaccccactgtgtgtatgacagctctgtgtgtggcagccaagccagcagccgaggcggggggagctgccacctggaactcggtccatgctgcatgcctcctgcacctccaacagggcccaccctccccctgggagcctggcagctccctgccttccctcgctctggcaaaaccatcttctccgcctgtctataagtgaggcttccgtttgagacagagaacagattccacctctaaagccctcctcacagtggccctgaaagcctggccctggctttggacaccaagttcccacctctgcctgtggggccctttcgagcctcagcagtgccagtgggtcctactcagtcaggacccactgaccggtaggtccactctcctacggtcccctgagagctgcatgcatcgagccccactcagccatcatggctcaggggagcccgcccgacccctcagatgtgactggccatgctcttgccacagaggcctcatccatcctcacatctccagggcctgtgcaccggaatgtttgtggatgggaagaacatctgcctaaaggccctgcacacagctgtccccaaaccgcaccggccacatggcaggtcctcactccacgagatgcagccatcccaaacggggtcacattccaccaggtgcacccttgcaccctccttttcatggattttggtgcttcatgttctgagaggatctctgtgtctgaatcctttcccctttgtttcaaaaccctgcctatttccactggaacaagccttccgcctctcagggatgcttgggcagagcagccaaaaaaacaaaaacccccaaggtcctggtaatttggaaagcattaatctgtcatcttttaactcaaatctgggccagttcgggagacaacgaatgacctttctctcttgggagaggagggaaggtcctgtggccacgggtccaatccccagggctggctggctgggctcgctcctctccggaaggaacccagggccggccggcggggctcgctcctctccggaaggaacccagggccggctggcggggctcgctcctctccggaaggaacttccagagggaagagactgagatcattctggatccagactttctgccaacgtgtctcgggtgcagagtttccacttaacgttgacccatgaagataccaacctcaaaataaaacacttcatcgaactggggattgttggtcttcctcttcactttcgtcttctttgcttctgatctgttatcaagtgagaaaggattgggattaaaacaacactgctgattccaagtctctcagtggtaaaaccgagctctcaaatgcacaagtcacttattggctttatttattttataaatatttctgctggtctccaactccagatggtatgcaaatcaggaacctttactcagccaaaaatacccagcgtgaagagcatgaaggcttcattttctacaaagcaattttggagcaataaagaaaacaaaaggaagtaaaaattcacattctacctcaaagcgcaacctcctgactcctcccaaatgaggcagtggtctcgtgatttcagagctggaccctagccccccaggaccagaacagaaacctgaagcgtgaggcaacttgcctgaagggtcctgccagcgtcacggtggcgtaggggtcacattgcccattcacgatggggaggccctggcactcgacgatgctgaggagagaagcagaggcggcgtcaggagggagcgcagacacctgggcgaatggcgagacagctctgggtcaggcaggaggcctgagttcaagctgtgagatgaggtttcctcaccggaaggcagggagggccacaccagccattctgcctcggtgtgacgctgaatcacgctggccattcacaaaagcccaaaacaacacctctaaggtgagcatgtgctttagcgtggacgccagcagtgtgtgacagcacatctaaagcagcgtcatcgggggggcggggggcaggacccctaaaacagtgtcatcctgggggccaggacccctaaaacagcatcatctgggagccaggacccctaaaacagtgtcatctgggagccaggatctctaaaacagcgtcatcctgggggccaggacccctaaaacagtgtcatcctgggggccagggcccctaaaacagcatcatctgggagctaagacctctaaaacagcatcatcctgggggccaggacccctaaaacagcgtcatctgggagccaggacccctaaaacagtgtcatctgggagccaggacctctaaaacagcgtcatcctgggggcccagaacctctaaaacagcgtcatcctggaagggggccagaacttctaaaacagcatcatcctggggcaacctctaaaacggcatcatcctgggggccaggacctctaaaacagcatcatcctggggccaggacctctaaaacagtgtcatcctggggccaggacctctaaaacggcatcatcctggggccaggacctctaaaacggcatcatcctggggccaggacctctaaaacagtgtcatcctggggccaggacctctaaaacggcgtcatcctggggccaggacctctaaaacggcatcatcctgggggccaggacctctaaaacggcatcatcctggggccaggacctctaaaacagtgtcatcctggggccaggacctctaaaacggcatcatcctggggccaggacctctaaaacggcatcatcctggggccaggacctctaaaacggcatcatcctggggccaggacctctaaaacggcatcatcctggaggccaggacctctaaaacggcatcatcctggggccaggacctctaaaacggcatcatcctgggggccaggacctctaaaacggcatcatcctggggccaggacctctaaaacgacgtcatcctgggggccaggacctctaaaacagcttcatcctggtgggccaggacctctaaaacggcgtcatcctgggggccaggacctctaaaacggcatcatcctggggccaggacctctaaaacggcatcatcctggggccaggacctctaaaacggcatcatcctgggggccaggacctctaaaacggcatcatcctggggccaggacctctaaaacggcatcatcctggggccaggacctctaaaacgacgtcatcctgggggccaggacctctaaaacggcatcatcctgggggccaggacctctaaaacggcgtcatcctgggggccaggacctctaaaacggcgtcatcctgggggccaggacctctaaaacggcgtcatcctgggggccaggacctctaaaacagcatcatcctggtgggccaggacctctaaaacggcgtcatcctgggggccaggacctctaaaatggcgtcatcctggtgggccaggacccctaaaacagcatcatcctggtgggccaggacctctaaacagtgtcatcctgggcagccaccggctctggaaattcttgtgcgttggtgtgaaaacccctgtgtgctcctcgggagccagacatgccactcgctgtgcgctcggtctctagtgaggacgtgtcttaccgtgtggcgagcttgtggcagacgaccccagtgtctgtgatgacctcgctcagccgcagctccaggtgcactttgccctgcaaggcacaaggatggggtgtcagaggctgtggcgctgctcccacaggccactagggccgcgcgcccagggaaagcctagagggcaaagggagcaggcggccccgccctgccctggccaatgggcacgtccagcccctccactccacccccgggacgcagggtcccagctgtggcctttctccaggagagctgcttgcctgactgctcagccccatgtggctgcccaggctcctggctctgctgagagcaggtcgctgcctcagaagtgaggggtccaaccgtgtaggagacggtcattcagtgaagcagacccccaaaggctctgatgctgcaggctgctcgtgtgtccgtcgggacaaaccagaggggaagcacagctgtctcccaagcaggggccactgcctttacctcccctcgggcgaggccggatggaggcccgcaggaacctcggagagctcacacagagggcaaggctcacacagagggcaagactcacacaggaggcaagactcacgcagagagcaagactcacacagagggcaaggctcacacagagggcaaggctcacacagagggcaaggctcacacagagggcaagactcacacagagggcaagactcacacagagagcaagactcacacagagggcaagactcacacagacagcaaggctcacgggggcttctagcagagcagacagcaaggctgccctgcgggtccacctgtctctctagatcagtctgtctgtgtgtgctgctgtgtccatccacctgtctgtctgtgtgcacggctgtgggtgtgtgtccacctgtctgtgcgtacaactgtgtgtctgcctgtgtgcgtgcggtttgtgtgtgcagctgtgtatgtgagcatgctgctgtgtgtgcatgtccacctgtatgtgtgtccgcctgtgtctgtgcatctggctgtgtgtgtgcagctgtgtgtcctcctgtgtgtgcggctgtgtgtctacctgtgtgcgtgcaactgtgtgtgtctatgtgtgtctgcctatgcatgcatgcgactatgtgtgtccatctgtgctgctgtgtgcgtgtctgcctgtgtagctgtgtgtccgcctgtgtgtgcggctgtgtgtctgcctgtgtgcgtgcaactgtgtgtccatctgtgtgtggctgtgtccacctgtgtgcatgcgactgtgtgtctacctgtgtgtgcatgtgattgtgtgtatctgcttgtatgtgtccacctgtgtgcatgttcgcctgtgtgtgcatgcagctgtgtgtgtctgcctgtctgtgcatgtggctatgtgtctgtgtgggcgtgcgattgtgtgtgcgtgtccgtctgtgtgcacacggctgtgtgtctgcctgtgtttgcatgaaactgtgtgtgtctgcctgtcggtgtctgcctgtctgtatgtgcatctgcctgtctgtgtgtttggctgtgtgtgtccttctgtgtgtgtgtgcgactatgtgtgcatgtctgtctgtgtgcaagcagctgtgtgtgcatctgcctgtatgtgcatgcaactctgtgtgtgtctacctgtctgtagtgtgtggctgtgtgcatgtccttctgtgtgtgtgcgcgactgtgtctgcctgtctgtgcgcgtggctgtgtgtccacctgtgtatgtgtgtttgtccgcctgtctgtacatgcgactgtgtgtgcatgtctgcctgtgtgtgcaccgcctgtgtgtatgtgtgactgtgtccacctgtgtgtgtgtgcggctatgtgtgcctacctgtgtgtgccgctgtccctgtatttgctccagcctgaatggcaatgaatggatgggataaacacagactcatccatgcttcaggggctctgcctggcccggcccttagctctagctcctgaggctccgggaaggccaaggcgtgttccccagggcttgtccctgcctgtgggagggtgggacagacgggcagaatgcctggcgctaagacgtggacggcagaaccgacagcagccctgcagcacgtggcctggtgcagaacctcggatggagcagggacctcgcttaggccccacccacctaaatgattaaaaaaccttcgagttccttcaaaaatatatcagacacctagccagccttgagtggtaaatcacctaacaagcaaaataaataataaaataatagccaaaaaattagtcaggagatatttattccctatacaagttaaaaatagcatcttaacatatgtccctaaattgtttttcaaaaaccgagaccctcaccaaacagatctaccaacacagaccacaaatgcaggggggatcacaggcccgaaccctgaacccggctctattctgaatttcttcctcaggggccaggaggggtcatgcctgtgggccagagccaacattcttttctgctgatctcaattgtttggacaaagcttctcctccttaaccaatcacaaatcaaaaacgctctatatccgacccatgggccacacgtcgtgatgtctgccttctcaggtcaaactgacatacggcctccatgtactgatttatgactttgccacaacctcagcctccccaccttctgaaacccttgcctgtgaaccctcggggtgcctgggtcgtgggcgcagcctgccctgccagggtgcacaccccgaagcccctggtcagggagtggaacataaagcccttcagccctcacttgacaccgcgtcggtgcagccccacggcacccccacacttgatactatgccccacggcacccccacacttggcaccacgttccacggcacccccacactgacaacacgtcccacggcacccctacacttgacaccacgttccatggcacccccacactgacaccacgccccacggcacccccacactgacaccacgccccacggcacccccacactgacaccacgccccacggcacccccacacttgataccacgttccacggcacccccacactgacaccacaccccacagcacccccacacttgataccatgccccacagcacccccacacttgacaccacgttccacggcacccccacactgacaccacaccccaaagcacccccacacttgataccatgttccacggcacccccacacttgataccacgttccacggcacccccacactgacaccacaccccacagcacccccacacttgataccatgccccacagcacccccacacttgacaccacgttccacggaacccccgcactgacaccacaccccacggcacccccacactgacaccacgccccacggcacccccacactgacaccacgccccacagcacccccacacttgacaccacgttccacggcacccccacacttgacaccacgttccatggcacccccacactgacaacacgccccacggcacccccacacttgataccacgttccacggcacccccacactgacaccacaccccacagcacccctacacttgacaccacgttccatggcacccccacacttcataccatgttccacggcacccccacactgacaccacgccccacggcacccccacactgacaccacgccccacggcacccccacactgacaccacgccccacggcacccccacactgacaccacgccccacggcacccccgcactgacaccacgttccacggcaccccacacttcataccacgttccacggcacccccacacttgacaccacgccccacggaacccccacacttgacaccacgttccacggcacccccacactgacaccacgccccacggcacccccacacttgacccagcgctcacagggggaatggaactgggtctgtgctgcccaggcaggtgtgggaggtggggcctccgctgctgtcctgagactctggggtctggaggttgggtgtggccttcccgccctgtggctgcagccccagagcaggtcctgaggggccacaaggatgttgggccgggaaggtgggcatgaaccccacgccagcactgtgggcggggaaaacaggtgcctaaaatgacaacaaagaccccaccaagaccacagctcctcttcccacacccatcagagctcagggctgagcggagtatcgcctgtggtcctcaccgcctggcagcgggcctgctatccgtggctatccatgggctaaaggagtgccctgaacaccagccgggcagtgggcctgctatccgtggctatccacgggctaaaggagtgccctgaacaccagccgggcactgggcctgctatccgtggctatccacgggctaaaggagtggcctgaccaccaaagacaggagaaagtgcctgacccaagaataaccaagaatccccactgcttcatccccgttctcaaatgccgggcgcaaactctctcaggacagaagcgttcagatttgcaaggctgtgcagacggaggtagctctattcacattcgggagcttcaggaagagtcacgactgcatgtggggggtcctggtccccagcagcaggctgtgtggcccccgtgtgctctcccggcccctggcagcaggctgtgcggcccccgtgtgctctcccggctcctggccgggtccaggggcacctggctggtcaccatcaggtcctgaggctgctcctgttcctgcagcatgaatccctcctgaccagctgacttgtgtgctttcgtcttctgctgattcaggagtgggaacaaacaaaacccacccctggaaggccctttctcctgccagaaaagccaatgagtaaatctgcaggtgctggcgcaggctggagaatcccagacatttagaggttaaacaacacagttctaaataacacacagatcagagaacgcaagacaaattttaaaatgttccggaataaacagaaatgaaagtgttactcatcaaaatcagtgggatgaagcgggagccgtgctcggggtggaggggaatctggagtgccggccacacagactagagcagaagggagatctgaacgctgacctgagcttagagcagaagggagatctgaacgctgacctgagcttagagcagaagggagatctgaacgctgacctgagcttagagcagaagggagagctgaacgctgacctgagcttagagcagaagggagatctgaacgctgacctgagcttagagcagaagggagatctgaacgctgacctgagcttagagctgggagactgagaaaaatgagtaaactaaacccagagcccaagaacagaaaacagaagtcagatcggaaaccaataggtaaaaatcaaagccaacggcaaattccttgagagatcaataaaattaataaacctcaaaccaggctactaagagcaaaagggaaaaggcacaaattcccacaggaaaggaacgagaggacctggctgccgaccctggcacctgcctggacgctgcactgaggtccctggcgctgcactcctgcgaactcacagacgcagcaaaggggccccagcgtccagctcctgacaacgtgtggctgcagtgtcacccatggggccctgggcgggggctgctgaggggtgtatggaaactctgtactctgctcaatttccctgtgaacacagaactgcccccaaaacagagttaattaatttttaaaaagcagccaatggtccctatccatctttctcaggaaggccttccccagggagagagcagcgcgcagagccgggtcagggtcctggccccacccaccggttgccgtgtcccccactgagcgggcagcggcccagagagcagccaggacagaggtgccttggatgcaggactgttccacgccggccgcagagaggagacgaagtccgcgggcagatgagacaggatgcagaggccatgaggaaggaagcccagcctcggccgtctcctcttacaaccctggagagatgtgaaagcttgacgacggacggtgactttgtttgctccgaaaatccttccaagaggactgtctgctgcacaaacacaaaattcccagaggctgtagcaggaggctggaatttccagcccagtgagatttcacggtgcaactggaaggctccaagggggaaacacgtaggtgtctcttgggcggatggcagacccaggggtttgctgtgatcccctgcagggctgtgctattttctgaatacgtcacagatgcacttgaaagcctggtttataaacggagctcagtgacccccaggcgcccagatcaccgcggatgcctcgctgtcacaggcggtgccctcgctggcatctgacgctggcatctcccccactggcatctgacgctggcgtctcccccgctggccctgcatcaggggagggtcagagagcacaactctgcataataaagtgatttaacaaagactttccaacagtggccgttccagaaggaagcaagaaaggtttaattgtgtttcccccatttctgtgactcacttgctggcctcccccatgggctgcttctgtgacactcgctgtccggacacaggactgttcctgggaatcacagagcggagggactcatggagccacatggctaccccctgccttcctgaaaatggtcactgtgacatcttatgatgaaacggcggctcctgagactggagttgtggggttttttttcttcttcttcttctttttttgagatggagtttcactcttgttgcccaggctggagtgcaatggcgcgatctcagctcacagcaacctccgcctcccgggttcaagcgattctcctgcctcaacctccggagtagctgggattacaggcatgcgccaccacgcccggctaattttgtattttcagtagagacggggtttcaccatgttggtcaggctggtctcaaacacctgacctcaggtgatccacccgcctcggcctcccaaagtgctggaattacaagcatgagccaccgcgcccagcctggagttgaggttttaaaggttggctggagtccagcagggccactgctccctgtcacgctacgttttgggcggcgttggggctgactgcatcagtgaagcaacgcattggagagcagcgggcattggagagcaatgaccttgcctcctcccttttagacaacagctcgcatttgccttccataaagtgcaaattcccgggagactgacaccactcggttcaggatcctcatgttccggacagtgagagtcaggcttggaggacgctgggcttggccacgggtacgcagcctcgggcgttaattatgagattccaccagctgtgagatcaacctgcggcattcttatttacagctttgtggagatgcaacgtctgagtcctgatcgtcatggtggttacactatctaccctgtgatgaagttgcaccgactgtcacaacagcccatcggcaggtgactggagcaacagcacacgcttcgcacctcggaccattcctcagccttggaaggaaggaggttctgataccacaagcgacccggaggatgtcacgcagagcgacattagcctcagaaagaccagcagggtagagctcactcccatgagccacggggagtggcctgcgtcagagacagagtgccatggggctgccggtggggaaggggcggacgggagcgtgtgaataaaactctagccaggggacagaggggacggaggttccgttttgcaagatgaaaggagctctagagatgggtggtggtgacggttatacaatattatgaatatattcaatgctataccactgaattggacattttaaatggttaaaatggtaaatttcatgtctctgttttaccacataaaaaactggaaaaaatagcatagaatacacagagagacacacacagaaacacgtgcctgtgaactggtgaaatctggataacatccgtggactgcacaaacgtcggcgtcctggttgacgttgcaccagctgcgcatggcagtgcctggggaagccgggagaagggagcacagccttctgtttggggaagccaggagaagggagcacggccgtccgttcgggggagccgggagaagggagcacggccttccgttcgggggagccgggagaagggagcacggccttccgttttcagggaaaggtgggaattcgcccctcgccactcctgtgtactgttttgatgccttcctatagatctataaccatttcaaaattaaatcagtaaaaaaaaaaaaaaggcaagaaagaggaaaagctacacctgccaataaaaccaaacttgaatccgaggcaaacgacgaggccgcactctgccagctgctcagaggccgttgtgacggagaccccagcgacggcgggtatcccagaatagaagagctggggaactcgccgacacgcaggcgggagcggcccagtcaccaagccccgtctcccgggcagcacgtgggaaaccccgcctttctgccgggacgccaaggtccgtgggagcagcacgctggggcccttgtgctccggggatgcgaggacagtcattagttctgcagtaatcacagcgtccttcactttccacagcacgtgtgggttccccagccagtgctttcccaggaagcagagttaattaagtgtgacgcacaattagcacaggtcccttggggcagggccatccccagggcttcttggctccactccttaatttccgtcaagggcctcaccccacccccacagctgggctcatggtcaacttcatgaatgaaccctttgctggccatgggcgtgtgcacagctcatgaccttggcaaatggcaaccttgacccagtgaagcgcagaggatgagggttgccagggcaagacggttcccagaggacgagggttcccagaggacgagggttcccgagggatgagggttccaggaggatgagggttgccgggggacaagggttcccagaggacaccaggccatccagtcccccagcccaaatttgccctgaacttgcgggcacagagcctccatccgacccacccagttgcctctgctgaagtctcaggcgaagtcctcacaaggaacctattttggggatttgtccaggatgccagcctccaggtgtaaaaataaccatcacagccaccaatttacgatgcgccaggtgccttcgagtggcacacacgccataccagcacgcttcacaaacccacccagatgggaaaactgaggcctgcaaaggacgttggcaacaatccgatgagggagctggctccgagcctggcggcctgtgctgggactctgcactcagacacacactgtggtaccagctgaggacccaggaagccctcccacatcccagggccgctgtgctgcaaccccatactcagacactcaccctcctacgtcccagggccgctgtgcagcaacactacactcagacactcactgcggtcccagctgaggacccaggaagccctcctgtgtcccagggacgctgtgcagcaaccctacactcagacactcactgcggtcccaactgaggacccaggaagccctcccgcgtcccaagggcgctgtgccacaaccctacactcagacgctcactgcggtcccagctgaggacccaggaagccgtccggtgtcccagggaccctgtgccgcaaccctacactcagacacttactgtggtcccagctgaggacccacttgggaaaccctcccacgtcccagggttgggccacggtgcctcttgcttgtggcctttgcagctgctctgtgtcacagaccagggctcagggtgaccccacaggagctggtgcaggcttgggctccggtggactgacccccactgctccctctgttacaggcaagcctggagcagctgttgccgggcagctgggcaccgtgcgtccgtgagcagctgtgaacacaagggtctgggacatgggccccagcactggagcccccggtcttgcgtggggaggtgggacaagctccccccactggacaggaccggggtgagccccagtcagcacacagtcccggcaagccagggtgagcccctggccactttcgacaatggacacgggagaccagaacgctctttcagctcagacccttcttggtgccgcgtgccaggcaacagcccgcccagccaaccgtggggaagtgagggtccctgagggctgaccctggctcggcccttccccacccatgttttctcttgggcctcaatgacgcgtgcctgtcctttcccaccgtgtttgttttcacagcttcctcagttgtgcatgacaaagggcggcagtaggcaaagggaaaacccaaaatccatgcacggagcccaggctcactccgagcacaagtgggcgaacagacacaatgcaaaatccatgacagagcctgcgctcactccgaccacaagcgggtgaacacgcccaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcggagcccgcgctcactccgagcacaagcgggcgaacacgcacaacccaaaatccatggcggagcccgcgctcactccgagcacaagcgggcgaacacgcacaacccaaaatccatggcagagcctgcgctcactccgagcacaagcaggcaaacacgcacaacccaaaatccacacgcggagcccgcgctcactccgagcacaagcgggcgaacatgcacaacccaaaatccatggcagagcctgcgctcactccgagcacaagcaggcgaacacgcacaacccaaaatccatggcggagcccgcgctcactccgagcacaagtgggcgaacacgcaatctgctcatcgttattcccagtcaaggccgaagcccgatctacgtctttagccacagtcggagccgggcccgtctcgaagccccatggtgtcccagggctctggtttccggggctgcgccgagagtctcacctgcacttccgagtcagcgtccacgtgctgcagctggaaccaggtgtccctgttgtggtacttctgcaagtcctccttctggatggccaccttccctgcaacacaagcagagaagacttcaccacgggcacaggccccagagccaggacgcctgtgagcagaagccagcccatcatcaccgcagcttatttccaacagtttaattcagaatggggcaccggccgggtgcggggctcatgcctggaacccccacgcttgggaggcccaggggggagggtcgcttgagaccagcctgagcgatatggtgaaaacttgtctctacaaaaaataaaggaatgagccgggcatggtggcactgtatctctaaaaattgatattaaaaagtcaaaataatcaggtgcagcggtaagtctccactgtgtcccttccagtaaggcgttccagaggcttcgctgtgaaggcgcgaacgtccgctccatcggcaatgtgcgcctcactttcactgtggtccgtggccagttctcacagcaggaggtgcctcggagctggctgcaccagagctctgatctcacaaatgaacaccccgtgcctcacacaccaccaaggcagcagcatcacgccacaagagacacgtgtgcacccgtgcgagcgacagcctgaaacacacgtgtgcctagggtgctttccgtgtgtgtggacacgcacgtgtgtgcatgcatgtgggtgctcaggttattcacaggcaggactgagagccagaatgagctgccaccttcccacgcgacgtgggttggtctgaatctgtgcctctaaagtgtaatgaatgagccgccttctgggacccctggagagcctgaaagtgtagattcctggccttctccagacggaggagaacagaggctctggtgtgggctggaatctgcaccaccacaggtccctgggcacttgtgtgggccccaaagtctgggaacgtccactctaaacagtttcccgtgccttaaacaggcttagtactttggggctacgcttccagtgaaaatacgtatcagaatatatttgtacaatatacgtttacctagtatggatttatatgtgtaaattcgcatctgcaaccattattatctgcttatacgttcacctcattccagaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctagggagtcgcacacacatgtgaagtctgagcccatcacagagcacacacgagagcaggagtgaggaaggaaatgttggcagactcctcacgtcttcgttctgcacccagagacacacacgccctccttaaggatcttggtccagtcactgaagtgagaaactctgggtccccgcagacccggttcaccgcagcgtccgcagccacagggtctgagcacattgtgcatgacctgggctcccgggagcggcctgggcctcctacccggccaccctgcctcacgccaggacagcgcagcccagccccggttctctcttccaaggaagatccttttatatttccgtgtctcaaaaaacttccgcaggctcccatcggaacaaccctggcctggcatccagcagccacatgcttgggcctgattctctgtccagcctcagtaaattcgggaacactccactgccagcctctcacaggtgccatctcagtcggtcctgcggtgaccctggaggagcaggtaccactctgcacaccccacagacgagcaggccggggctgcagggagagggagcttccgtccctgccttcctgccagcgttccttcctatgttggcgtccccaccctgcgaggtcccaggacgcatcttccctcaggagctcctctgcctcgcgggctcatgcgagcgagacctctcagcctgactggtccattccgtgactaatctcagagcccgtgggcctgggccaccaggcccctcctttgtctgcaaactcagagggtctgagacacgcccagctcagcaccagctccagaccctatgggacagcgcaaggtcggccacatgatggagcaccacatggccacaggacatggtgggaggtgcggaaggtggaaagaggcacaaagacgctttccaagtgcccaaaggagagagacggaatcaggacagtttgcctccagtgctgctgacacctgccatgcacgtcagcatcttcatctgatgtcctcaggggagccggctgcacctcacaccatccactctgcaaagcaaagcagccctgggaacagccctggaaaaagccccttcccagctccgggacccccgctcacagccagggccggccagttccacagctacccggacgtagatacagcacacaggcactcatgggttcctaagatcagcctggtgacctcatcggctcagctcttgccacacagacatacacaggccatctggagctgcacgggacgctgaaaccaccactgagggcaggcgagagccaaatcaagaaccaagggggccggcacaggaaacaggccccagcacatgtgggagaaggaacaccagggaggctcagagagaaatccagtgacacaccacgtggactccctccaatggcctctaatggcgcagaccacgagggtggacgacagccaggacacctccgcctggcccacctcactcgctgagccccccgccccgcctcactcgctgagcccccccgccccgcctcactcgctgagcccccccgccccgcctcactctctgagcccccccgccccgcctcactcgctgagctcccccccgcctcactcgctgagcccccccgccccgcctcactcgctgagccccccccgcctcactcgctgagccccccgccccgcctcactcgctgagctcccccccccgcctcactcgctgagctccccccccgcctcactcgctgagcccccccgccccgcctcactcgctgagccccccgccccgcctcactcgctgagcccccccgccccgcctcactcgctgagccccccccgcctcactcgctgagccccccgccccgcctcactcgctgagctcccccccccgcctcactcgctgagctcccccccccgcctcactcgctgagcccccccgccccgcctcactcgctgagccccccgccccgcctcactcgctgagctccccccccgcctcactcgctgagccccccccgccccgcctcactcgctgagccccccccgccccccccgccccgcctcactcgctgagcccccccgccccccccccgccccgcctcactcgctgagctccccccccgcctcactcgctgagccccccgccccgcctcactcgctgagctcccccgccgcctcactcgctgagccccccgccctcccaccggcagccctgggcgggcgcctttgacttcaagggtccggagtgggggctctgtcctctcctctgacgaccgctgcgtggctcttgcataacctcccctttcccccacaacacgaacctcagttttgagtctcacaggaataaagccacatgaaagcaaaaacttcttaaaactgagttgggcaatatatttcagtgaaaagggataaatcttcagactccaagacgccttcagctggacaggagggtcagttttgaagtctgaagttttaaatacttgcaatgtcactgtgtcttcacatttttatgagctgaaactgggacgggagaagtcacatatttacgtggataaaaatcttgtaactggcacatgattacaagtctttaattttagaagtacttcacttaattttttaataggtaacacagaaacagaacaaaatccacaacattcaaaaggatttaaaatcccttcgagaagggatccctgcccctgccacctcattcccgacgtggggtcacttctgtcaccagcccccaacctttccttctagaagccagccacattcaacaatggggaccgtggacatttgaagcatgcgtgttcgtatctccagatgctgacctgagagaatgcctgatctaaaagccacggcgtctacttaaatttctctgatgtgcctaatccacagggttgtccccatctatttgagtcacaccgaaaagtttaccgaacactctgggcctccctttctcacttgggcaaaggcggctgccttctcaccacgagaggccggaagggtcactttcttctgctgcatctgtgctggccaggcccgttcagaaaggaggagccaggggtctggagggcatcagacgggggaccagctgcagagggaccagaaaaaggggaaacagccacaggacacaactgagcaagagctgcccgagacagggaatgcggctgaaatgcgcgcgcctccctctgaccccacctgtgtcccagccagggccacgaggaaaaaacaaaggccatacagatcccaaaggaagaaataaaagcctttattcatagaatgtacaaaaaaaaatctacaggcaaagctaatagaactaattggtgtgttcagcaagaacagagaacacaaagtcagtgtggagacgtcgactgcgtttgtacatacaagcaatgaccatgaaaattacacaaaaacagcacctttcacaaaattatgcttttaggtttgtgcttttggtggactacctcagaaatctttaaccactccactaaacacataaaacacagggaaataaatgtttttaaatgtgcaaaatgtgtaggctgaaaacacatcacaaaacactgatgagagaaattggaaagacccaagcgtgtaaagatataccatgtccatggatttgaagactcagttttgttaagatattaattctccccaaattaatctatagatcaatgtaatcccagtcaaaattcctgtgggactattttggaaattgagaagctcattcaaaagtatatatggcaattcaaagcatctagaatagaaaaacaagtttaagaacaaatttgatgatcttacactacaatgtaagacctgctatgaagctatagtgatcaagactgcgtggtattggcatgaggacaggtggatcaatatgacacacagcaggcgagccccaaattggggcttagcctcagagggtctgtagcttcactcaggaaagaattcgagaatgaggtggtggtggaagaaaacagttttatggaggcggcagtggcagctctgaaactgctcctgcacagcaggactccccacgggcggggtgttgacagtctcagccgttcctgcagagaagggttccccataggcagggtgttgagagtggcacctccgggcactgctgcagtcttatttatcctcacttttaactatatgtcaattaaaagattatgcagacatttctagaaaaagggtggtaatttccgagtcacggggttgttcctatggaaaggggtggtaacctccaggcgttgccatggcaatggtaaggtgacatggtacactggcaggcgtgtccgatggaaagctgcttccacccatccctgtctcagctagtcctcaatttggttcggtgtccgagccctgccttcagagtccagtcccgcctcctacctcagatggaagagaatacagaggccacaaacagacccacacaatgcagccaactaagctgtaaatgtgccaaagtcatcaacggaggaagggtcgtctttcagccaagggtgccggaacaaagggatgtctacatggaaaaaacagaatcccgacccttttctttgtgctataagtgaaaattagcttgaaacagatcatggaactaaatgtgaacgctgaaagcacatgctttccaggagaaaaccgccacaaccgtggaataggcaagactttcttagacatgacaccacaggtacaaatcatacaagaaaaaaatgtgataaactggaccatcgaaattaaaaacttctgttcttcaaagccaatggtaagaaaatgaaatacaagccacaaactggaagaaaatatttgcaaagcacacttgtgatagactcgtatccagaatatacagggaactttaaaaagtaacaagaaaacaacccaattaaaagggcaaaagatttgaacaatgtactaaagaaggaatggagctgtcactaagcccaagaaaaggtcctcgacgccactcttcacggacacgcaataaaagccacagtgagacagtacacacctatgggagtgcaaacggtaactagagaataaaaactcacagtcctaagggccgggcaggatgcgaaatacctgctgctctcacccgctgctggagagaaggcagactgggtgaccacttggagacacggttgggtagttttaatgaaagtaaacacacaccctacagtgacccagcaacctcgctcccacgcatttatctcagagtaagaaacagaaacattgtccacacaaagacctatccgagaatgtttacggtgactttattcataattcctgaggattagacacaatccagagggtggatgaggcggctgagctgtgtctgtatgatggaaacccacgggcagtggaagggggcggcctggctcacagccgcacagcgcgggaccagcgcagtggcagagggcacggcccctccagggtttgagtcacgtggcctcctggaaaaggcaactgtgggaacaggcctcagagcagtggctgcccggggctgtgggccagggtaggaaatccaccccaaaggggcccaaaggagtgttccgggctgtgggaacatatcttagctgtgctgctgtctacacaactgcatacactggtgaaggctacacctaacagtgaactttaccatatgtcagttgcagaccacctgatttatacacaaagaacggaggtctcggccgggcgcggtggctcacgcctgtaatcccagcactttgggaggccgaggtgggcggatcacgaggtcaggagatagagaccaccttggctaacacggtgaaaccccgtctctactgaaaatacaaaaaattagccgggcgtggtggcgggcgcctgtagtcccagctactcgggaagctgaggcaggagaatggcgtgaacccgggaggtggaggttgcagtgagccgagatcgcgccactgccctccagcctgggcgacagaaagagactccgtctcaaaaaaaaaaaaaaagaagaagaaaagaatggaggtctcactgcacccccaccccattgggaagcctcagagagtctctaggggctggaggggcaaatggagggggacatggtgctaccagagccggggcccagaggaaggtggaggcctagcgggaaaaggagggaggcgccaggatcgggggcggagaccccaatgctcctgacagcaccgagccgggcctcgcgcatttccgtggttcccgcatcccagctgcggggagccatagtttccggtctgtgctctgtgagggcagcgcccggcagccgagtccaggcagaggccgcctccctgcgcctggaatcccgaaggagcctgcgccccgtgtgtcccgcaggtcacggccctgcagctgggagcccggcttgactgacagttcccgccggcagcagcgctctgtgggccatggacccagggacagaggaggctacggtcacgccgcccgggacccgccgacactggacacttctcctgctcctgctgtggcgggagctgactgcagccggtggaggtgccggggtgggctggggagggctgagggcaggcctttatttccccaagtctcacttgccggggcgccgtatcccggcacggcttcagctgcctttctcggtttctgtcgccaccgccctccccctccaggctgaagatgccctcccgtccccaacccacacccccgaccccataggaatgcacccccacttccttctggcacctgccagtgcacctctcactcctggacctgaacttgcaactgagcacagctgtggctgccccaagggaaacttgctggcaggtggggtttcctcagggcgtgggcggctgctagaaacgagaaccaggagaaccacgcagccaggaagccagtggccaccgcgcacttccacccagaaacgcattccccagaacctggtgtttcatgcccggtaacaacataattaccatcataaagataaatcgttaccggagatccagacagccacccattttcatagctgcgaaagccacagtgaaacatctaagtccagtcaccataatcgtaaagccaccaagaactactagcagacgacgtcaacagaatgattaataaacatcttatttggttattttcagagcatataactccagaactaacttgatcagcttctcttactaaaatgtgcaaaaattttttaaatttctttttccttagggttgtcgctcaaaaaatgtctcatacaccttcgagaacgaatcaagtccctgtggattctcgagtataaacggagctggtgacgaggcctgacacacggtcacacctcaattcgcgcgtggcgcccggcacaggctgagccccgccagatacaccattagcctccgctgaataatctggattccatgcctccctttcttctgagaacacccttggaggcccctggcaggggctgagaacacaggagcgagacacaggcctgccctgcaggaccatgggctccaggaagctctgtccagtggacacagcacaacaggcaagagaaccacaaccaacgagtggggcaggggaggcaggtcacggagggcagcccacccatgccgcggggtcggaggccatctcctgcagcaggccccagtcccagaggtgggcatggcaggacatggggatggagaaggaggtgcctcaggagtggggtgcacagcggctgagcccggaggcaggagggagaactgccagccactagccctggagccgatgccctggtcagagggagagaggaagagggaacccttccgcagcacccagcttgaacgcgacataaagctatgggcctgaacctgagggcctcccaggcagacactgagcaagggggtgcaggggtcacgctggaccctcaagaccatctcaccgacaaggctccatgaagcccagcacagcaagaccctgaaggggggtcaggtgcccgctgcactcagacaccttctgcagccgcatttcagggccagggtgtccgctgcggaagcacccagcacagtgttcccgctcaaaatgaagtcaaatgtcaattatctgagatccatgtgacccattccatgtattttctaaacaaactctggagacttctatgaaaaacacagcagtttctaagaataatcacttgggtacagtgaacaacagtcccaaaaatgtccgggtcccgacccctgcaatggtgagggggcactggccttatcaatgccaggtgaggccctgcccggccccgagggcctctcacccagccaagcccctctcaatgccaggcagagagcaagactggtcaggataggcatctcatctctgtcaggggacttgctgtggaggcccgggacatggcagagtgcagacagcctacgcgttacctactagcccgtttctctcatgccccctctctctctcaacgtcgtgctgacacacactagctgccggccgcccagtggggacaggctgggttttaggacactcaagctctgaggtggacctttggccgtgcctctcacttctgtgtgccaagcactgggaatggatcagatcacagatcctggtccatggctcacaaacagaggaacagggacgatgaagaaagcccacagctgagggacacaggtgagcgctggggaaagggggcagccggcgtggggtggagcggccgtgacacggtgtgaggagccagtgtgagcagcgagcgtcagatggaccgggaccccgcccacgcacagcaccctcgtggcctcgctggcctcctgcacccccgggccctcaggctgcctggggccaagctgggggtcccctgggggactcctcctctcgccctgtcccactcagcatcccggcagccatgaagacgaggagcctgcaccacctggggtctgggttcaggctgtggcagccagtacacactggctccccggccgcccgtcctgggcgtgagctcaggcgccacaggacccctcctcccttcctggctctcccagcgtcacggcgggaattagcctgatccctcagcctcccacgcctgctgcgtgaggtctgctcctgacggggtcctctggctgcatttaggaacaaggagctccccgagtaacctgaagtccactctgcccagaggccccacaacttacaggatgccgccttcctgtgataccaggcagggctgcccatgagctttctccaagagcagccccacccctgctccaaacacaccatctcctggaagtaacagtattgccccaaaaaccagggggaaactgaggcaacatgcccccacccccacccgcccttcctgtgcccacactgtggggactaaagttgggacagggacagccaagacgtggtgaggagggaggccccacatccatgcaaaggtccccccacagatgccccggggaacagccctgggaagttgtctgaagagggccagagatgctgtgctcttgccttgaggggccatggaagcctcgactggcagtgctcactgacctgagcctggtgtgatgctctagcagggaccacagatgccaggccagatcccaagagcagatcaggaggaacacccagggctgctgtgacctcaagccctgcagcgacccctcagcaccatccagccaggctctggactgaaatgctaatactcgcctggtacagaacaggcagaaaaggggaagtaaatgctcattcatcacctacctatgatggaatccctccggaaaacgtctctatcgaaaatgtagaaggacaggtgacgaaagctccgaggaatttcacagtaaaagtcttctccgtaaaacgggctagtgagacaaagaaaagcgccagttagaacacaggccacgcttgcgcctcacccccggggcacacacgtgtggtcttagttttaaacatgccataagaatgccctgcactgtgtggcacgcatgagacatgaacctgcagctccctgtggggtgaagggcctcgtagctgctccccggcctccacctcgagcctttgcactgcacagatgaacttctgtactgggctgcctggcggcccggaagctgagacctccacagagaccacggccactgccagaatgacttccatgctacgtgctcaggtctaggtgcagcctcagggccatcgtgatgtttcgaaggtacctggtttggggcaggcagtggctccctttatgcattaaacataaaacacagcactccagtgccttggaccgctccttttatccagagatccagtacaaagtcctgactgcccagccgccctcactcctcggggagagacccccgctgctgactgtacttagagtcctcgctcctgggggagaggcccccgctgctgactgtgcttagagtcctcgctcctgggggagagatccccgctgctgactgtgcttagagtcctggctcctgggggagagacccccgctgctgactgtacttagagtcctcgctcctgggggagaaatccccactgctgactgtgcgtagagtcctcgctcctgggggagagacccccgctgctgactgtgcttagagtcctggctcctgggggagagacccccgctgctgactgtacttagagtcctcgctcctgggggagaaatcgccactgctgactgtgcgtagagtcctcgctcctgggggagagacccccgctgctgactgtgcttagagtcctggctcctggggaagagacccccactgctgactgtgcttagagtcctcgctcctgggggagaggcccccgccgctgactgtacttaaagtccttgctcccggaggagaggcccctgctgctgactgcccagccgccctagctcctgggggagaggaccccgctgctgactgtgcttacagagtgcatggctcaggccgcccatgcgtgagtcaccaggagatgcagccgccccacagaggagacttgaaataaccacaaccccaataaagaagcagaagccagtgggctttgccattcagcaaaccttcctgttgtcctgggctggcacaggtggggttagtttcctccccacgccggacctgttggcgattactgcggtgcacgcacagctaccaccaactcagaacttaaaacaagcccactttcatgcacattgatgctaaggtccaaaataggaaagatgtaagttattcaaggaggaaccattctgatagaaagcaaaggaaggtcaacgtgctgggccagggggcgtccacacagtcaccaacggcacaggccccaccccagccacacacagaaatgagctcagaccccgcacccatctgtaagggtgtaagggttggagctactagcctctcagaagaaaatgagaatgaacctgcaccctaaagtcaggtaaagatgtcttagatctgtcaccaaaagcacaagtgccaaaagaaaaataaatggaaaatcaaacttcatcaaaattaaaaacattaaaaacttttttgcattaaaagcattatttaaaaagtgaaaagggccagtgctgtggctcacgcctgtaatcccaacactttgggaggctgagactaacgaatcacctaagatcaggagttcgagaccagcctggccaacatggcaaatccccatctctactaaaaatacaaaaattagcagggcatggtggtgggcgcctgtagtcccagctactcgggaggctgaggcaggagaatcgcttgaacctgggaggcagaggttgcagtgagccaagattgcaccactgcactccagcctgggtgacaagagcaaaactcagtctcaaaaaaataataaaaattaaaaaaataaaaagtgaaaagacagactagaaaaaatattagtaagtcagttatctgataaaagacttatatacagaatatataaagaactcttatgactcaataaatgatgacaaataattcagtttaaaaaggggcaaaagatttgaacacacatatcaccaaagacaaatggccaacaatgtattaaaaatgctccatgtcattagcccttgagaaaatgcaaattaaaccaggagatacggcacaggcataagcccaaacctggggcgggcgactgttgctgcccggagcccaggtgggaggggcccagagtccaggtgggaggggcccagagtccaggtgggaggggtccagagtccaggccccaccccttctccctgcagcggccttaatgacaggcatttcatttggatttcactgatttcagtatttttataactgggtcagagactgggtaacatttactcagaaaaccattttttgtcataaaacaatcttccaagggaagcctaaaatgcctaggttgttttaagcattttggaaacacagcagtatccatttacacacaaaagaaacatcactttatctttcaatgaaggcagaatgctcagggacttccaccgactccattgtagcagcatcctggttaatgaaggcccattagaaagtcacgtttcctttaaacacattctcgcgttggtcgttgacgcagcgagccatcctctgatctcctgcgtctgcgtgggcaccgccgagatctgatgtcagggacccccaggggtgtgtgtgcccacaggcatgtgtgtgtgggtgtgtgcacgtgtgtgcccatgggtgtgtgcacgtgtgtgcccatgggtgcgtgtgcccacaggcatgtgtgtgggtgtgtgcatgcatgtgcctgtacgtgtgtgcccacaggcacgtgtttgtgtgtgcatgtgtgtgcccgtatgtgtgtccccacaggcaggtgtgcatgttcatgtgcatgtgtgtgcccacaggcacgtgtgcatgggtgtgtgcatgcatgtgccatgcatgtgcccatacatgtgtgctcacaggcatgtgtgcatgttcatgcgtgcatgcatgtgccctggagcacttgggtgcacatgtacacaaaggcaccacagatgcgccccacacaatgcgctgctttcataacaaggcgcaggggtcgtgaccctgcctccaccctgtgtaaagtcacagctgcaggatctcggggcaggacgcacactccccaggcagcgccctgtggcctccctggagaagcttggtgctctgcggacagcgtccccactggcaggaaaaaccactatcaacctcgaagccaaaagggacaccagacgtgcattttaatattcacgacaaggcctcaggtgacgagctactcacaggacaagcgttaacaattaatagtaatccacaaaacatttgggatttttacaacgacaaaacggcctcttctgtacgtcctagagcaactttcagggccactgaggcctaagtgatggcaggaagccgtggtgtttgaatgtgtgaaagcagcctggacttggcgtttccagccccgttcgctcccggcagagccccaagaaccaagggctggaggcttcacttcctgctccagagtggcaggtgcccaggctgtcctggctgcggtgcatctcacacaagaagcccagcgggagcacgcacagctctgggccttgcggcaaatgcgtaaccaaaaggcgtaaatcaagcttcgttcaccatggaggaacctcagaaccaccggcaccgatagccaagctgccagagaatggaacggacgccctccattggcacaaactccagcagccggcttgtcaggaagctgcagcagcttcagagcaacccaggcctcggggttcacctggcgcgtcaccgtttcccgagagccccccgcccccgcacaggcactgaggaccccaccacatgggcctgtgcctgcctggcaggaaggcagggaggaggaagtgggtcgggctggattgcatgtctgatgtgtgtccgatgaatgtccagtgcgtgtccaatgcgtgtctggtgagtggtgagtgtctggtgtgtgtctgatgtgtgtctgatgcatatttggtgcgtgtccggtgcgtggtgaggggcggtgagatgaggatgccagcgctaagcacaccccacaaacgggcgccgcgcacctggcatttaaccctgcacacttcctcaccaccctgatgcacagggtgggaaaccgaggcactccaacatctgatgaaacgaaactaaccccagggcttgggcagcagggctgagagtgcggcgtccctgggcgctgcccggtagcggggtgttcagttgctctgccaaaggctctgcacaagtggctcctctctctgtaactctgcttggcagtggggggctcggtggggggaggcccgtgctggctgggcacctgggagggtcccgtgaggcttctggtggtgctgacagctgtccgtggaaattgaggtgcttaaaattcataaataaaccagaaatccattcaataaaaagagataaaaatagcagaaagaggaagctacaagaaaacatacgaactccataaaattatcaccacagactggacgtgcccctttctaaatgtaaaagcggtttatagcaacacagcatggccctgctgcactacccctggggagcaagacctcctccagcctccacccaggaatttctccagcaatggctttagaaccttgctcctgaatcgcagcaggggaggcagcgctttggggccctctgtcaggctgccccccctgctaagaggagctgttgtccttgggaaccacgggtcccccctcctgaagaaggggaacgtcacactcacagttccattttacacatttgcagctgagaaccctggagccagaacaggctccagcacaggcgatgggtgagtgttttgcatgtctgatgtcgtttattctagtggttccaattgcctattttaatgtttttcttcttatttcatataactttttaaacttaaagtaataaagttattactaactttgtttcctgcgggtcacctcaagtctttcaggaaaccaggcaggacatctgcaggcggccggccagccttatcaacggagctctgagccaccaaccactgtgaccaagcttcattcccacgagctggacgagcagaaggcattgcagggcagtggggtccggagaggcggccgtgctacaggccttgcactcattttaatgaaggctctgcaggatttcaaggaaagctggagccagtctctgtgccagaatagagggttcgttcagcttcttagaccgatgatttatttagggaataagaagggcgattccagggacagtggaggcccccacaggaaggaaacctctccccacaatgactgtgcacagagccagcctgacacccaaggccacgatgccatagccagggagccctgaagaaactcctggaagaatgtaaaacccccagctcaaggaggagagtggaggcggttccccaccttctgggggcagttaacctctgagaatgaacccacagctaaaacccataaaacctccgccaaccacacccagacctggaaggggcacctctggccagggcgctcagcacgaggggacccagaacaatggcttccctggggtgcgggctcggcctgcaggatggaggctggagagctgccatcctagcgcacactgggtagatgcaggtgtttccaatgtgctgaagagggcagggcctggctgaggccctgggaggtcggagtcccggaggtgggtgggggtggtgagttcccaggtcacttccccaggtgtgcgttttcctcactgtcctgtcctattcattcattttagcacggaggccagaaccagccgagtgaagcccctgcctgaccactcaggggtgtgaggacaggggcgaggaccgggatcatcagtcagctcctagaatggcaggtttgtacctgcaaacggagcaccagagtgacatccccccaagacccccgagatgccatgagccccatggagaccacccacccggcaggggccagctccaggtgctgctgctgcggcgaggccgtcaccaccatccacgcgtccagcaggaagagcggattcctcgggcgtgaggctcaccactcacgttgtctgcacacctgcctgacgacctctcccgaacctggattcccaccacagaattcagctcctcgggtgctcaccagcccgtgacttgtggtcaccagaccggacggaaaacacagagaccatttcctgttttgcagaaaatcctgttgggccatgccagtcctagagccaaaacacggtgtccacttgagggtccagacctgaggccacccttgctgggacagcatctccttccctctcagagcaatgccactgatgcccagaccagcaaccatgcccgtcctcgcctgcccgacaatgcccttcccaggccctgctcctcggaggactggtcatgggcaccctggactatgccgacccgcagtccccagggaccaagtcctgctgctgtggacacaggtgaccctgcccctcgcaggggagctgctcttctcctgagcccaggagtgctctgaaacttatatcccaatgagaaccaaaatcaggagtagaagtgggagttgaaggccagagcctttttcgaagaacttccctaagctcttttaaatacctgcatccaggccagatgcagtggctcacgcctgtaatcccagcactttgggaggccatgccagaagcgccacttgagcccaggagttagagatcaacctgggcaacatagcaagaccccaactcaacagaaaatttaaaaattagatgggtttggtggcgcacgtctgcagcgaagcggaggattgcttgagcccggggttccaggctgcagtgagctgtgatcacagcactgcactcctgcctgagtgacagggcgagatcctgtctcaaaaaaccaaacacctgcatctcctgcatcttcagagcacagtcccgcctggaggagccgccgtcaggccctcctgcatcttcacagcacagtccccaggtgcagctgctccccccaacctaattcaggccctggtaagcttcacaaggccaaggggacgttggtctccaccaggaagactatatggcacgtctaaatgtaagaatctgtgacagacgtcgctgaagccaatgcgaggaggcgcaggtacccaggaggcacaggtacccaggaggcacaggtgcccacacgggccttgccgggggaagcacgactttgaagatggggacgtccacgtttcaacgctgccttgccagaggccagttccctcatctctcagcctcaggacaccgccctctccacagtgcagcctgcgggcacagagggcgctcggctggggaagggcagtggctctgcccccaaagcggcctccccaggacacaccactgcctggcttggaggtttcttcctctgccctgcacagtgagacaagcacatggcagggcctcccacacaccaggaccaaacaacggggagcactttcgatgtctttggcccccgccaggcgtggctcactggacccagaaaccacagcgctctctctctccatgactgtttcagctgcccatccccgttctagactgtgggaatagcagccaatgaagcaaagtcctggccccatggagccagccaaagagcacacagaaccacgaatgtccaacgcgggcaaggctggcgggggcagcactgtggcctcgctcgggggacagggaggcttacggacgagtgagcgcttgaacagcgctgtggacggtgaggagacccgcaggaggacaagggaacgcatgaatgaggccatggacggcgcggagagcgcaggaggggtctaggcagagggacaccaggtgcgaaggcctcgaggcagcagggcttgtgtgtggtaaagacgtaggagcaaggagaaggctgacgtggcctgggcagggcacggcaggaccggagcatgctgggagccgaggtcagaggtcagggtgcagccgaggtcacgtggtgcagagcagacatttcaccacagcagctgggaatatgcaggcccgtgcaagacactggatggacggatgcacggatggggcagtgggcatgcagggaggaatcacctgtctcaggtcagcagccaggagctgcccagacctggcacagtggaccaggaagggaaggtcacccaagcctccacaggtggggctttctgcaagcaaggtgcagcggtcagcccgagaggccacggtgccgagcaaatcctggttgtcctcatggggacgacaggaattcagttctggcagagccaagactgccgggaagccagaggggctcctgcaggaggtgacgggcctgcggggacgcgaagggccaggaccggacacgccccgttccgctctgcttccagtgaggcgagaggcgggcaggacgcagctggagccgcgcacgcccggagctcaggccaggactgtcccccagcgctgcgctcgcccgcggtggagctgcagtgttatcagtggtcagctcaagtccagtggcttgaaagggaggcagaggcctcaccttccctgaggctccctgtgaagagcaggaggctgggccctcgggaagaccccagccaggctctgccacctccacagccgggagacggggcctccaaagccggcagacggagcccccacagccggcagacggagccccccacagccggcagatggagccccccacagccggcagacggagccccccacagccggcagacggagcccccacagccggcagatggagcctgggcactgcacacagagacatttcttcttcccgagacctcgcacagaaattactcacttaaaagcacttagagttttttcattttttcagtggcaaatatttcgagggaataccacagaaatagccacaccaaaacccaactcagttctcccttctccacccccgccacggccggggacgctgcctcgatgcgcggggctccctccgccatggccggggacgctgccttgatgcgtggggcttgggttcttcaggtctcttgatgtttttcctcttagaaccgcaaactacggttgcctgaaaaggtttctaaaaaccccaggcgcccaggcccacctcagagaacggctctttaagggtgatgggttatgaaacaggagccctttgggaggccaaggtgggtggatcatgaggtcaagagattgagagcatcctggccaacatggtgaaacgccgtctctactaaaaatacaaaaaaaaaaaaaattactgggcatggcggcaggcgcctgtaatcccagctactcaggaggctgaggcaggagaatcacttgaacctgggaggcggaggttgcagtgaaccgagatcgcaccactgcactccagcctgggcgacaaagcaagactctgtctcaaaaaaaaaaaaaaaagaaaaagaaagaaagaaatacgagctttgaaatctatactagccatggagtctaacacgatccttaagcgaactgctcattacaaagcgtggcaggctgccttctctccagagggtttctggtgccctatccacggaggcggcagtgggattcagccgtcacctgtgcttgcggtggtaactccatctcagactcaacaggggacgtgtctgcacagagcacacggcgcaggggttgggcggggaggacggcaaggtcaagccagctcaggggacatggtgggcagggggctccagatcccacggtgggcagaaaaggcgggggtcggactgacgccgtcctggaccatgtccacgtctggggtctgcaggttccatctccctttccactgtgcctaaccttacatctataacctacatccagcaagacacgattttccacgatgagttgattcgtaattccatttatgtgcaagtttttagaattttcctgtgggttttttttttacttacttatgattttaattttgtttgctttaaaaaaaacacatgcataggaaagaatgcttcctttcatttcaattaaaaacaacaaattgcttttttttaagcaaaaattcattgagggggggctcgcattgtacaaagaaaatcagacccaccgggatggctgtgatcaaagagacagtaacaagggtagggaggtggagatgcgaatccaaacacacaacttgtgcaaaggtcaagtggccacagccgccacggaaaacaggctggcggttcctccgacgttcaacacacagtcgccacgggacacagtggttccacccccaggtgtgcagcaatagacatcacagcccacgtccgcacgcagactcggacacgcgtgctcacagcccacgtccgcacgcagactcagacacgcgtgctcacagcccacgtccgcatgcagactcggacacgcgtgctcacagcccacgtccgcatgcagactcggacacgcgtgctcacagcccacgttcgcacgcagactcagacatgcgtgctcacagcctcagtcatgacagccagacagtggaaacaaggcaggtgggcctcggctgctgagggagcaacagcagaacggtgctcagccctggagaggaaggacgcctggaccctggccccacaccacagcatccacaatgtggtgccaaccaacaggccacgcacacagaggccatgggccagacgcttccactgacacgaaatgcccaagagaggcacagccggcgacagaacggggacccgtgtctgccgccccaggagaggctgcaggccggaaactggaggattacagggcgcgagtgtcgttttagggagatgaaaatgttctaaaattggctgtggcaattgttgcacaactctgcaaatatactaaaaaccactgaattgtacatttcaaaatgggtgaattgtacggtgcttgaattatacctcaataaagctatttttaaagaaacaaaattttaaatacgtaaaaaaatcagaaagtgaaatctggaattaacattccaggaaacatcctcctggagttttttctccaaaaatataaaatagaataaaatatataaatgttataggtttaaaatatacaaaatataaatatatttgtattacatttataacataaatacaatatttataatacaaatataagtatattcatactataatgactcattatattataatacaaatatattaacaataatagtaaatatttatgttataaatatagaagatacgaatggaaatacggataaattttttaaataaaagtgaggttatgttccctgtgacagagtcagctttttcctttcacatcaggccatgggccactttccaaagagctgataaaacgctggggtcagacggcacgtgtgtgcgtggacagcagtgccaggtccccctgccatgtgcacgctgtgtggtgggagcagcaggggtgagcaccctgggaacgcagatctgtgcagtggctgattgtccccgtgggataaattcctccaaggatgtgcactgtcctgaggcctttgaaacacaaagccacagaaccctccagggagtctggaccagtgtccacccccagcatacgccgtcttataaatatttctacagtttgctaaaccggtggcaaaaacctgcttaaattttaaatgtctggctcattggtgaggtggaatgtccatctttttatgagcagttttaaatctcattttttcttgaaatgctctgggcctgttttctattagaatgaccatcttttcatgctcaggatttaaccctccgggaacttctgaatgtgtgttgcaacttaaaagacatattatttcacaacatttaaggaggatcttttttgaactaaaaaaacccccacaaatttgttaaatttgtcaccagtgggtgactatggacctgtgatcagccaactctgaaatgagctccagcagatggacacagcgtcccaggacctgcaggagcagaggctgcgaggccagccacgtccacctcgatcacgtcacctcgtgggcagaatggcctacgccccatgtcctcccagccccacccagaacccacggtgagcacccggcaggaagtggccacagcaccatcactggaggccacgcggagtctgaggacagcagctttcccccctatgctgttgtggggactccaggctcagcctgaggacagggtcagttccctccacacagcaccaacactcccaggtgcaaagcccaggcccacggacagccccccgctgtccgtgggtctcatggtgggggcacccattttctttcatcagcaggaaggtttgtgctttctccttcctgggcagcagagtttgaagcgtattccaaaagaaaaatgaaaccggctgaacgctagggcattcctcccatcccccatcctgttcggtggcctgtgccggacaatctcttctttctgatggactcaaaggggccacacagccaccaggtgccccccttcccatcagcagcttaacctcggggtatctcttggacaggccggctttgtctccagccgaggtcagcagcagtcagatgcgggatgaatgcctggcccaggcggcccccactcaccgcccgagggctctggaactctctttccaaataaagaaaaagtgcggcctgagaggaccaggctcgcctgaaatcctgccatgtggcctaaggaaattaacgcacgcagcagcctctccctctgaggcagagaccctggcaaagtctcctttccctcagtcatttctggaagaagtgcaaatgaagtttcacagaatcaagcaaactttcacggggaaaaaagaaaaaacctcttgcagaaaacagagttgacctttaagtagtggctctgatgaggggaaaccatctgaactgaattcctcctcctcctggagcctggagcaggggctcagctgggaccagcagagaaacccccgccttctcctccctgagtcacttcccagcatctgcgcaaggctggcgctgccccatcccgcctgcggctgctcccatcacgtgatcataagaaaataaacctggtttcccagctctgtgctctgccgcaggctcggggcccatttcccaaacgctggggggagccgggagctgccagggctgccccagcctcggggtagagggtaaaggctgcgtgaagaggaaccaaaccccaaaccgggtctgcgaagcagccctggggctcccaagccagcctctgggctgagctctgcggtcctgagtcactgcctgactcatcctcagaggcgccccacagagaaggggcaacttggccagggaaaatgctccatctccgcaaaggacaggaggcaaaacacacccatcagaagcacatggccagtgcagggccacacagccctggctcccacagaccgcaggctggagaatgggggtccgcggtcagctcatagcccacccgccacccagcactgcagggtcacacagccctggctcccagaggtcagaggctggagggcaggggtccgtggtcagctcacagcccactcaccacccagcacggcaggtctcagcggaagccccacacacactgggttgcagcctcctgtggttcaagatgggtggggttattttgaaatgttggcaaatagagctgtgagtcttcaaacggaacccaaagactcagtgaggaaagcaggcgggctgggctgagactcacagctgcagcggccgtggtgagccacctcacctccccgagcctcagtctccccatctgttcaggggcaccgaggagctgcccctcggctcatgggctctgtggtcgccaggcacgccacacaccacacgccacacaccactgcacgcagcaccccgggacactgtggcctcggctcccgcctctcctgcacatgaggctctttcctctctcccaccccataccccccaaaaaagaaccaccatccttacaaacaaatgaaaatcggctgggtctttagggcccggccacgatgtgtgactgcagcagtgactctcaggaggaggcacaaccagacaccgggtcccctgcagcagctgagacacctcaaaccccaaaccctcagtgaggccctggtgggaaaaggggctctccagggaggtgccaggggcaggagagagggccagcggccgaggagcgggaggcggccgggcgagaggaggcccgggcaggagggagaaggggggacctggcctttgctcctcatgggatcctcggtgcggccccctcgtgacaggcccagcctctccctgcagtggcccagccacagctcagggccaggaggctcctgcaggcacaggcggccgatgagtcccttccaggcctgggcctggggcagcctgccatgtgcagtagacactcagtactcacagaatacgagcaacctcatgctctccgccggctgagttcctgtgcggctgagagaaccccctgcatcattctgacacaggtgcgctcctgtgagccagcatgacacggaaggacacacacatgcaggtggagatggagatgctgggccgggcttgggggtcatacagacaggaccaggggctctgacctgctgggagatttggggccagcattccaggactgagagaacagatccctggcctggggtgctctggggctgaggatgggcccccacctgggctgaggatgggcccaacctgggctgaggacgggcctccccacctgggctgaggacaggcccccctacctgggctgaggacgggccccccaacctgggctgaggacgggccccctgacctgggctgaggactggccccctgacctgggctgaggacaggccccccaacctgggctgaggatgggccccccagctggggcactctggggctgaggacgggccccccacctggggcactctggagctgaggatgggcccccacctgcggtactctggggctgaggacgggccccccacctggggcacttctggggctgaggatgggcccccacctgcggacaccccggggctgaggatgggcccccacctggggtactctggggctgaggatgggtcccctactccagcagttctgggatattctgggcttcaagaagcctccagtcgtgtcaagcaggtttttgtttaagctctaacttgagagtgaaaataaatgttcatgggaaatgtgacttttcatgagtcgcctaatgtcaaagtcggtgtttcctaagtcagcaacttggtttttattaaaagcatctgagagaatgaaccgtctgtctcccaaaccaccaacttcctcctgcccctttcagtttctaaccccaaataacttctcccctcccgaaaaactttggagctgtggagacatttcttggtttagtcatttctactacacaaaagtactattttgggggtgatttacatcttgcagtatgaacagaaagaaacctccctgtctttaacaaacacccactgcgtgcacacaggacgggacgggcttccacccagaagagctcagagcctgcccctcagggctgccaagtgagggtccctggtgatgtctgatgtcctcgtctgcctgggaagacccagctctcctcgctcagctctagaagatctatctgttccttgacttgtaacttctaattgtacataaaacacacaaacaaaagaacaagaactcccccataattccacttctcagaaatcacatcacattgacgtttttgtctgcgtatccagatcattttgggggtgctcatgattttttaaacaaaagaacttttcctacagacacagctttgtaacctaacgcataaccagctttcggagcaggagttcaggccgtggcacctctgggtggagggggcacagaaaccagccacgcctgcagtttcttcctgttgtggccacggccccttctccccgagatgggcatgcaaatgaaccctgcaaaggacgcaggagcaactccacagaaagggggggccagggctccgcgtggggcagagggctttgcccagcctcaaccccagtggcagggggtagggtcagacccagaaccctgaggcagagcctccctgagccaggactgtctgcgtggatgagggtttggggagaggtcagccacgtgggcgcagaggaagcaggcagggacagacaccattccacgtccttacgtggatggaaggaaatgaggacacgacacttactgaatattcttgcaaatgactggactaacccagcaaggagagatttaggttctgttgtgtgtgacgccagctgttcctttctgctggacaagacggtgatttccactgcagcgcagccttggggagcggggtcatctccttgttttagggtcgtgggtgccggcccaggggaggtccagggcgggaagctggttcccaagccccagccctgccaacccaatttcagggagccttttagtttaagtaaataaggaaacaaatagtggctgccctttaaatgattaaaaatgattgctctaaaaggtatggattgtgaacacagttcactctcaacctcagaaaattatttttctagtaggacagaaactgccaaaatcacttccttggagaagggccaaggccagagagaaagggcttgttctctgaaatgtgtccacttcgatgcgttctgaagttaaacctgtgacagacactgcccttcaacctccaccttgaaaaatacagaaaaaagggaagacagaggacgctctccccagacgtcggctcagcactcgataaagaggccccacagactccagggcctcggacgcgcggcccaggggcccgggccacacgcagggaggaggcgtgggggacacaggcctgaggtggagctgggtcggtgacctccttagtgggaaagagggaagaagagaagctgagttccgcctttccttcctcacacattccatttgcagcttcctgctaagtcagacggcgatattgggcaacagcaaatcaaacttgacccaagtgcttctccccagggaatgtgagaaggggctcctgcccggctgcagacccagcggccagagagcaccctggggcccttctgagctcagagatgcagacgtgggcttttttctttccacagcgactttgccaaatgaaccatcagaccttaaaggtgacactgaccttggaggaagcacacggggggctgggagactcagggaccgggagacttggggggctgggagactcgggggccgggagactcgggggaccaggagactcagggggccaggagacacaggggccaggagactcaggggtcgggagactcgggggttgggagacttgggggtcgggagactggggggtgggagactgggggaatgggagattcggggaccgggagactcggggagccgggagactcggggagccgggaaactgagggggccgggaaactggggggccaggagactcggggggccaggagacttggggggctgggaggctcgggggctgggagacttggggggctgggagactcgggggccgggagacttggggggccgggagactcgggggctgagagactcaggggaccacttggggggccaggagactcgggggccgggagacttggggggccaggagactcaggggccgggagactcaggggtcaggagactggggggtgggagactgggggggtgggagactcggggactgggagactcagggagccgggagacttgggggaaccgggaaactggggggccgggagactcgggggccgggagactggggggtgggagactggggggtgggagacttggggactgggagactcggggagccgggagacttggggggaccgggaaactggggggccaggagactcgggggctgggagactcaggcggccgggagactcgggggttgggagactcggggggccgggagacttgggggctgggagactggggggtgggagactcgggggatgggagactcggggaccaggagacttgggggaccggccccaaagtgggtgccaccatggagcaaggagggggcggtggccaggactaaactccccagcatgtggggcagccctgcctgacacctgcctctcaggtggatgtcgaccaatgactaatacaggactctgttaatgcatgtgcaccgatggagggcttccgaccacagatgtagcgtggattccagctgcaagtttatgagagagccagcttttgggttcaagtacctttcctgccaactttttgtatggggtgggttgatttgcgttttgccctcacactacaggggcggccagcccgcacagccctccaaatggacagggctgccagcgtccacactaaacggcgccagtgttacacgtgggcagggctgccggcgtccacgctaaacggctccacagtcttacacgtgggcagggctgccggcgtccacgctaaacggcgccacagtcttacacgtgggcagggctgccggcgtccacgctaaacggctccacagtcttacacgtgggcagggctgccggcgtccacgctaaacggcgccacagtcttacacgtgggcagggctgccggcgtccacgctaaacggcgccacagttttacacgtgggcagggctgccggcgtccacgctaaacggcgccacagttttacacgtgggcagggctgccggcgtccacgctaaacggcgccacagtgttacacgtgggcagggctgccggcgtccacgctaaacggcgccacagtgttacacgtgggcagggctgccggcgtccacgctaaacggtgccacagttttactctcttggaactgtcccacatgggtttctctttctttgctatcagtcttttgttgtgtgtgttttgggtttttttgagacaaggtcttgctctgtcgcccaggctgaagtgcagtgatgtaatcatggctcactgcggcctcaacctcctggcctcaagcaatcctcacacctcagcctcccaaagtgctgggattacaggtgtgagccaccacacccggccagaaccatgatttctatttctaaattcttctgaaatatctgaaagacaacaggcccccatttctcaacctcacctgaaagagaggttcccaaacagattctcctcccactggctctgattcagcgggtctgagaggatcccggcctgagaaagactgccagtaattctccaggcccacaatccataggcctctaacaacagaccatttaaacacagaatggacttttatccagggaagctccaaaggcacttctgaagggctcggtctcttcccattttcttcagaagaatggctgtgcccagtcatcgccatggcaaccccaagacactctcataaagccagactgggcgcctgacaatgcccctcagcctgcagttctttttgacgagttatttcaaagaacccggagcgtgcattaacataacacaaatgactctcactcctcggcctggagggcagctgcgccaaagccttttggaagcactgtcagtgacggagtgatatgagccccagtctctccagggcaggagacccctcacagttttctagtaagtaaactcacccagtcatcagcatgggttgttcattcccacttggaagtagccagatgcaaggatataattctttagctaaacatgttctcaaaatcaaaatagctgttttgatcaaagcacacgacccatgcttctgaactgaacggtgcagtcacagctgcaaggatgtcttctctgatccccaagccgctccttataacccggtggagtcacagctacacggacatcttctctgatccccaagccgctcccttataacccagccgccccatgcttcccccgaggccgcagcactgaggccctgcctggcacactctccctggcttctctcttcccacccccgacataaatcgccatggcttcctgtccctgtgcatcccaccccgtgccatgtcctggtgttcaactgcagtggtcctccgagtacggcctggccacttagctggagcttttcagaaacacaagttctggttgtgctctggacatcctggggtcggcacccacatcttcacacgctcaagttgagggggaaacttgttgattttaagagtttgtttttcttggctgactcctctcttcctcaaatcatatcaataaacactttctaggcctcttacctcagttaacacccatcttctgtatagctattttagaaaattttacaggaagagaaaagctttctcagtatttccccctctcgaaatccttaatttgtactcttttgtggagtgcgagcttcccggttcatctctaattaaaaagcactcgtgcgagtccacgcagggggaccgccgcctacatgcacttcctggacagcgggagcatttagccaacaccagttcacatccacgcaccaccaaggacagaagctcagctgcctgcacaccagagccccagggagcatctcctcctcaaactaagcaggaggaaaatgggaaggtgatgtacatgctcaggacataatctacatacagaaaaattctctacacgcgggaaaataggatggtgacgtacacgctcgggacactgtctacacacagaaaaattctctacacgcgggaaaatgggacagtgatgtacacgctcaggacattctctacacatgggaaaatgggacggtgatatacacacttgggacattgtctacacatagaaaaattccctacacgcgggaaaatgggacggtgatgtccacgctcgggacattgtctacacacagaaaaattctctacacgcgggaaaatgggacagtgatgtacacgctcaggacattctctacacatgggaaaatgggacggtgatgtacatgcttgggacactgtctacacacagaaaaattccctacacgcaggaaaacgggacggtgacgtacacgctcgggacattgtctacgcacagaaaaattccctacacgcgggaaaacgggacggtgatgtacacgctcgggacattgtctacgcacagaaaaattccctacacatgggaaaatgggacggtgatgtacatgcttgggacactgtctacacacagaaaaattccctacacgcgggaaaatgggacggtgacgtacacgctcgggacattgtctacgcacagaaaaattccctacacatgggaaaatgggacggtgatgtacatgcttgggacactgtctacacacagaaaaattccctacacgcaggaaaacgggacggtgacgtacacgctcgggacattgtctacgcacagaaaaattccctacatgcgggaaaacgggatggtgacgtacacgctcgggacgttctccacacatgggaaaatgggaaggtgacgtacacccttgggacattctctacaccaaagaaaacacatcagtgccaagtaaagcaacagaagacattaccagagtgacttttccacaattttggtcctgaaaacctcctcctggtccaggttcaccgtgcagtagcaatccctcatcttgctcggccccgggtaagagggaaggtttttggcttcacctaaaaagtaaaagcgacatacatcatcagcagcgtagaaatgtttgttccctgctacatcgcagacacgtttccagcctttgcttgtgtgcattcactagctctctataaagccttggtttttttgccaccacaagtcaaaatgtggatgtgcaccccatgtgtactgccgaaaggcgagggacatgcacgccaccctctaatgcaagtcccgcaagcagggacctgccagcctgggactcaggattgctgtgtcttgtttacctgcattagtccctttattttaatttttaacatacaattttccatctctgacctgctcgcgtgcacagttctgtggcattaaccacgttcaccgagttgtgcaaccatcaccaccgtcctctctggaacactctcgtcttcccaaacggagactcggtccccattcaacactcactcccatccccctcctgctgtctcccagtggccctcaccccactttctgtctctgtggatctgactactctggggcctcacgtcggcgggatccacaggacgtgtcctttcagcccggctcactctactcagcaaatgtcctccagggtggcccctgctgtggccgctgactggattcccttctattttaaggttgaataacttccatgatgcaaagggacctcgtcttgcttattcatttatccactgagtccctttttattttgaattttattttatattaggtcaaagttggagccagaattaaaggaaagagctctttcttgtggacgtgagttaactgtaaactccagctgttcgaattgccagtaaagagaagcgtcccagagggacctaagctaggtccacctctccctccttcaagcccacagagacgccacctggacgtgcttgaaggaagtggggccagttcctggctggccctgcagaaaacgcccgtgatcccggactccttgtttgccaggggtcagtctggaggtcataactgaaccccagctgcgacttctctgctggaagctcggagcatgccccagcggcaagcctaacggcccagtttactggagaatagggagtgagcaggaagggatgagtgacagctgtcaatccagacagcggatgcccagtttaagtccattctgtaaaaaaaacgcctcaaacacactcgcgcctccccagggccttttctgcctccgtcatttggctctaaagacgcctggcagtggcgtctccacgacgcaggatgagaggacagatgcaggcacaggcaccacgctgagaccacaccaaggctcctgctggcgccactcagggccacatcaccttattcttgttgaaacaaacaaaatcaaaaacgggagcagagtagaagtttctcagaaccccacttccgccactccgcgctgaatgtttcgcgtcaactcagcaagcgcacacgtcatggctcacatggggcagtcggctcatttcaaagatgccagtttgcaaactggcatgccagcaactccaaagggcagagataaactcagtttgaagctttttaaagacttttcatccacaatattaacctgaggcactgtgagaaggagcagaagccccagggtctggacaacgcctcccgtgtccgcgccgcgtatctctgcgtgtggaggcaccggcaggacgaagcctcccgtgtcggcgccgcgtatctctgggtgtggaggcgccggcaggacgaagcctcccgtgtccgcgccgcgtatctctgcgtgtggaggcgccggcaggacgaagcctcccgtgtccgcaccgcgtatctctgcgtgtggaggcgccggcaggacgaagcctcccgtgtccgcaccgcgtatctctgcgtgtggaggcgccggcaggacgaagccgcccgtgtcggcgccgcgtatctctgggtgtggaggcgccggcaggacgaagcctcccgtgtccgcgccgcgtatctctgcgtgtggaggcgccggcaggacgaagcctcccgtgtcggcgccgcgtatctctacgtgtggaggcgccggcaggacgaagcctcccgtgtccgcgccgcgtatctctgcgtgtggaggcgccggcaggacgaagcctcccgtgtcggcgccgcgtatctctgggtgtggaggcgccggcaggacgaagcctcccgtgtcggcgccgcgtatctctgcgtgtggaggcgccggcaggcgttcccagcagcacccgctgctgcccacacggagcagctctcagggtctcactgcttgcggccgtttcccgccagtgcccccaacacacagtctacctctctgggcctcaaagtcctgaactgcaaaagcaagagacacagcagctctcgaaggctcctccggctctgagacgcctctaattcaaaaggttctggaaatttttattttgggaatcattaaggaagcatcaatgataatcggttggtgggaaaaaatgagtatttcctgataggcactggaccctcagaacacctcaacacggcgactctcccgggatgcgccttcttcacccgctgcatgggagaacacagctaggctgctacgaggcacctggctccaggccaggcctcaggtcggtcatcccatgtcagaagacaggctttccgaaggctcccaccgatgtgaagatcccacacgcagcacacgcacacacgcagcgcacacacgcagcacacgcacgcaggcagcaccgcacacacacgcagcacacgcaggcagcacacgcacacacacgcggcacacgcaggcagggtgtgtgatgagttcacaggcacgaaggggagaacatggccggcgagcttctccagagagggaagggagcctgggggatggcagttgaggttcccggagcagacgcagccttcctggtggccgcggctgcccctgaatttgagggcagccgcagcacacccagcaagtcggacaggggcccctccagcctcccggccctgttttggaactgacggcttctgcagcagatagaagtccttaccctcaaacacagcttgactttgctgactttccttctgacacctttacagtgtgacctgacgctgaccatatttcccttgggattttactgggttttttgtttttgtctttgggagttttttgtttttgttttgttttctgggatttctttgttttttgcaacaaatgagtgtagatatttagctgtaagttcctgtgtttcttaaaaggagagagaaaaaagcttttgaaagtcctgtgggagatggtgtttgtggataatacggaactgagatttgttcccacagggcctcaaatcacagcagtaacagctgggtcttccgaaggcggacactgcaggacggaaacacacaagctttctgtggagtccctgtaagacagacgccgtacgacatgaaaaggccggatccccctgcgctggcgccaacacaccagattcatccctccctgcctgatgatgcccagtcccaccgcactggcaccaacgcaccaggttcctccatccctgcctgacgatgcccagtcctaccgcactggcaccaacgcacccaattcatccctccgtccctgcctgacgatgcccagtccccccacactggcaccaacacaccggattcatcccttcctccctccccactcaatgatgcccagtccccccacactggcaccaacgcaccggattcatccctccctccctgcccgacgatgcccagtcccaccgcactggcaccaatgcaccggattcatccttcctccctgcccgacaatgcccagtccccccacactggcaccaacgcaccggattcatccctccctccctccctgcccaacgatgcccagttcccccgcactggcaccaaggcaccgggttcctccctccctgcccgatgatgcccagtcccctggccccaaaacacaccaggttcctccctccccgcccgatggccccgtctttacctccttctccttgctcactgtcatctggggctgagactctttctttttaatctacttttgctatgatgcatttaataaaaaaaaaagtggggggacaaaatgcaagcccatttccctgcctcaggcttctgatgccatcacctccaaggcactggttttgtttccaactgttaataaagcattgaaacagaaaaaaaaaaaaaaaactcctgagaaacatcctggttgctatgacgacagcaacaccagggagcctgctggacgcaccaacatccaatgagctgctcagaccaggagggctggggctgctgcagcacggcctggccacgtcgccccggggcctcgccgtgtgtgccacatgcaccaggaccgagcctctccctgcagccccacagctgagcgggacgggggctgccccagctcccaagcaactgtttcttctccaccgcaccccaaacagttcattcagttaccttcaccaaaggtgcctgttctgtctctcttagaggaaacacgttttctcttttttttctggtgcacagagacgttcatataaaaagacaaagctgtctgtggtatacagtaagtacctaattatctgttgcatgcatggatgaataaatgaattaaaagaaaagtaaactggtttcatcctaacagccaaataagtaacagttctcatgaccacttttcccacagaccatgcctctaaaacatatgcggtgtgttcaccagccggcagactgatgaagacagccaacacagcacctcgcatcggctctgaaaactcaactaacaggagtaaaaggcagcacttaaacacatttaatgtaaacagcataacaccgcaaaacctgatttccaactccagggatcaggcagtgagtaacaaaaacaaaggccctgatccaaagcgtcatgactcccacgcccacggcagcccttctgggccatggagggaagctgcaccctcagggtgagcacaggcccagccctgaccgagggttaggatgcccaggcttccctggaggcccacacagggtctccaagtgctgacagcgagctgtcggggctgcccgcagcacccggagccacacccctgtacccaggaggagctgtgagggcatggggaggtctccacagaccccacccagcactgctcctccctgcaggcatcctggggagggccctcaggcggggctggcctcatgtactgctcaacacagcagcgggcgtctcccaggcgctcagcagctcagctcagcgcccagtgaagagggcggaggaaggaatgaaggcagccacgggtgaggacgagggcccagggctccactgagcaaagctcctggcaccaacccagacagaagacgtcctggagaggccagggctgtgctggtactggccgcgtccacccaggctgggcgctcttctctttcccacgtcatcacggcgttttactcaactacaggtcggcctcactgaaataacgtggaacaggtgatggcgacagccccggtgcatggtccagcgaaagcaaccccgtcccagcaataaagcccagggcctgttggggaaggagaccctgcgggagaattggaggaagtgcggctctcaaggctcccaacctcagccttttagtcgtcccaacgcaaaacattcaaaggggcctaaaaattttgctaggcacacagcgtcttctaacaacataaagtatttaccggaacaatagtcttgtgactaaaatatctgaataaaggatgaagagccccgtctactttgggctatttagaagcctggaacagcgatcccagccctggcccctgggatcctcactcgaacaggtcctcctccaggccctggcagggtctcagtgaggcacagaagcctctgtgccatgcgtgggtagagacccctctccgggctctgagctgctgactgcaaggcccatgtgccccctggctcctgttcgcctctggacacgggggctccgtgactggcctctgagtgggcctgagtgcccgtccgcactggcctccccacccggcaccctccgtgggacgaggctgcacatctcggtgggctgactgcggtgcagaggccataagaggaagaggcgggggggccccgaggcaggggacacagcgtcttgaggacacagcatgaccctgacccccacgacccctggcaacacaagtgccttcccgaagggcctgcgaagctgccagaaataggcagaactcggcgaggccgtgggagtggggtttcctctgggccgagtcgagggcagacggcacctgctctatcctcacgctcaggaggggcagaggccgctgggcttggatggagccaggcccaggtcttgtccagggctctccagggcaccatgctcctccctcaagaggactcctgtgggttatgaatgacagaagcccaggctgccatcctcaagcaaggcaccccccaatcctcctggccgggaggggctgctgggagcccctggcaccagcgggcttctgtgggcggtggaaggaggagagggctgtgcgggctgattccaaaactcactgggtgacaccacctgcccagggagggcccagcactgccgtccagggggtctgcctgtcgtccagtctccttgagagcacctccagctccctccagtctccacggctcttcagagggcacgggaggttctgctgaggggcgggtgaccaggcccagatgttaaaccctcccaaataacgggcatattcaatgtaattgaaacttccaccacagggagaatgagtctatggtgacggggtggcaggaggggtcctagaaggcgcccactgtgcttactggaggcctgaccccgacaacggctgaaacaggggtctcccccaggggccactgaaacaggggtctcccccaggggccacctcccagggcacgcttggatttcactatgggctgtgcaaatggcatctggtgggcagagtgcagggtgtcttctgttcagtgtcctgctgcacacggtgccccagggcacagggccgtccacctagaacaccaatagtgccgtgtggcagagggccgtccacccaaaacaccaatagtgcccctcggcagagggccgtccacctagaacaccaatagtgcccctcggcagagggccgtccacctagaacaccaagagtgcccctcggcagagggccgtccacctagaacaccaagagtgccccacggcagagggccgtccacctagaacaccaagagtgtcccacggcagagggccgtccacctagaacaccaatagtgctgcgtggcagagggccgtccacccaaaacgcaacagtaccccagttacacgctcctggtgcaaatgaccctcctctcgtgcttggtgcaaaggctgttagcaacgggccacacaggagatgctgccacgtcactccagagactcacgcgtcccgagacccaagtgatccctaaacgtctaggaggagacctggccttggagccaggtcagccagaaggttgtccaggccgggcctccccagggctgcccagtctcccgatgcagtataactctcaaggcgcgggggccgcatcacccagcactctggaaatgctgtccgcagaccacggccaccagcacatgcactctcgtggttctgactgcctgtgaatccagctggtctacaatgagccgctggggaaaatacttcaagtcctgagatgaatggagcaggaatgcctctggaatatcctgagaaacacgactccaaaccctgtcagctggttctaactgtgctcactcttataaacaggtaataaaatatgggaaagaaggcgattgcagacaggggacctctcctccacagagacgtgtccaccaggagactgaggcaaatcctatgggttcaaaaccgaagtttcactggcggctgaaaacacccagggaataacgaggaaagagaaggcaaaggtgggctgaaatgaagccgcccttctgagttcacaaaggagcagagacacaccggtgctgcacaggaacccccagggcccccgtgttcctagcgcagcagagcctgccccgcatccaggctgcatctcctggggctgtgactcctctcctgagtccacacacaggacctcacacctgcactcaccggctgcagctgcacacacaggagagcttctcacaggacaaatgcctggaccccacccagagattgccattctttgactaggacgggctccaggcagtaagaacagacattcgtcttgattagaaagcctgcaggtggttctgggtgcagccaggactgagaggcattacttactgctgagaactgagaaggtgtgaagatgcccctacctcctcgccccactcaccggggagctgcgggtctcacaggggcaggcaggaggccagagacgtccacgtctgagacaaaggacatcaccgcaacagcagagccagagctgcagcgtctgcaggtgccctggtttgcctcacgcagtaccaaattgggattgggaacccagtgatgcctgcacacatatcggctgcaccttgggagcagggcctgagcctggggaaccctagtctcttataacgggcagtggcaacaatgctgacatctgcctcggagagagatgctttcttcctgatcacggacagtgggcaaacctccctgtgctccgaggctccgaggctgctccccgggtggacacacgcgcttgaatggagagtgaggaacaaagggaactgggtctttctcccttgatgcgccgcactgagataaaaccatgaagaacgtctcccagctgcgtcccgtctgggggcagccccagagaaggaatggggggcagggaaaacaactttccttaacccaagcaacgtttagttcacacccagcctgtacgcaagaggggaagggacaggcctggggctgcacccccaggtgggtggtcccaacagaggtttaacaacctggttctctaggggaaaaatgcatgcacgagctcaactaggttaagtcatacattgcactagtgtaaaagatgtgtagcacacaactcacaaaaaataatgagatacacagtcctctacttcaaactcacagagctaattgattctcacagcaaactcttgtctctaagccaatcctgggctgcatttaaccaggatttgacaaacagaggcaacgcaccctctgctagctggttctcaaaaagtgcgtcatcactgagtgtgatatgtgtcgaccattaaaacatttctcccactcatacaaattatattaagctgacatctcttctggctttcacactgggaatgctggcgcttcactcattcatcaatgtcacaagcaactttgttgaatcaggtgaagttttaaatgccagaaaaacattgtcttaatttttttgtgctattgcagtgtaaccgctatatacaagattatttaattcagggtagcaagattagatgatcaacaaaacctttgttcaaacgtgagctcaatttcctccgatgtgtggcccatcctgatttctgtggtgtgaacattcctggccgatttcaagcgaccagtgtggccccaaagccagagagaggagagcagggccccgttcagaggcacccacacctccagaagcacccagccagacagcctggagcccagcagcaatggcgtgccgtgaaatcacaggaagtgctgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtggtgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtggtgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcacggggaagtgctgagtctggagtatttattcccttcgtcctcgcggggaaatcacaggaagtggtgagtttggagtatcgattcccttcgtccttgtggggaaatcacggggaagtggtgagtctggagtatttattcccttcgtcctcagcgtatgtgatgggattctgaatgggggctgtgtttatctgggcataaaactcctgaagattggcagcaggagtccacgcagagacctcctggagatgggcgcgctacacgagcttttgaaatgagcaagtttccagagccggcgggattgcgggggcacctgggaaggcaaagtcacctgcacccgctctgcagccccggcctgcgcctctggagggagggccccgggcagtgccagcaggaacgagcctgcctcagagccccaagtctcagtggagctccttccaggctgacatggggctgacggctcccggggccagcagggcgcccgcccgacaccaccacaacccatttcagtgacagataacttcagacaacttatcagagggccttggagggccggaggcagcaacacacacagcctgattctgggagcagcatttccttccaaaaaccttaaatcggataatgagccgggcgcggtggctcttgcctttaataccagaattttgagaggctgaggctgacggatggctcgagcccaggagttggagaccagcctggccaacatagcgaaacctcatctctactaaaaatacaaaaaattagctgggcgtggtggcgcacgcctgtagtcccagctatttgtgaggctgaggtgggaggatcacttgatcccaggaggtggaggttgcagtgagccatgatcacaccactgcactccagcctggatgacagagtgaggccctgtctcaaaaaaaaataaaaggaaagagagacacatcagtcacagatacacacacaacaaatctaaaatagacatgtgaaggcctacacaattaaggaataatattttggaaatgtcaatgattaacgtgcctttagacttaaaaaattctgctgtgtgacttattttctaacacctcagctgcacacccttgagccacagttctgctcactctcagggccacataaggaaggttctcagtcttccccgccctggagctcccagccatttgctctgatcccttctacagcaattctcttgggctccttcaagtgtaagcctcttgccccctagggaaaggaatgcctgaagaatcacacttcgacttccttatctgaaggccatacttgatggatttgaacagatttgcacatttaaattcccaaattaattttttttttttttgagacggagtttcacttttattgcccaggctggagtgcgatggtgcaatcttggctcacggcaacctccgcctcccaggttcaaacagtctcctgcctcagcctcctgagaagttgggattacaagcgtgcgccaccatgcccagctaattttgtatttctattagagacaaggtttctccatgttggtcaggctggtcttgaactcccgacctcaggtgatccaaccgccttggcctcccaaagtgctgggattacaggcgtgagccactgtgcctggccctaaaattcccaaattaattttcacatggtaaaatgttccctggttactaataacaataaataagattatggaaacaaagtagagacgatccgtaagaaataaatagggattaaaaactccaccatatatgaagttcataattaccagcacagcggtgcagggacagcccccagctcctcctcccagggcagcagagcctggcgagtcccgaatccctggtggagctcccctcaagcctcccagcagggctctgtcccctaagccttctgctccttcgctccttcctgctgcactttctgctacttgcacagcaatttctaatagttctcattagaggggcagagcagctgaaaagggtgaagaaaataagagaccaagatggcagggatgttcggaggaggagagaggaggggagacgaggggagacgaggggagacgagcggggaggagggggggaggaggggggagggggaaggggaaagctgcagagaatgaaggtgaggacctggtggaaacctcacagagggtgatttgaatacaacctgatcttccctggcatggagggcaggaggcggccacctgagccccgcacaggtgcccggcaagcccaggcagaggaccaagcagaaggtgctgtctgatccagccgcagaactaaggaacgcctttagcccctgctcccagctgcagaagagttgcccggtgacccaggaagcaggaggaaagggcaggcctgggccagccctgcacggacatcagccctgcacagacatcagccgcgcacggccgccccacagcctgcacacaggtgttcacggcacgtgtgtgggtgtcttgattgacaccacacaactccctgcttttaaagggcacgatcccgtggtttttagtgtattccgagttgagcaaccgttatcacgattgacgcgagcatttccgtccccctgaacgaaacccaccctcctcccccagcccccggcaaccacgagtccactctgtgtctctgtgggtctgcttgtcctggacatttcatggaatgggaccacacggtccttccccttctgtgcctggctgctttcactgaacgtcctgtcttcaaggttcgcccgtgcttagcccgtcacagctctgcccatcttcctggccagatgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaattaccctaggagccacccggctgcctgcccagggccgtgccttcacacctgcctgcaaagcgcaagcgttaccatgtctctacaccctcgtcagcacttgttactgtctttttggttatatatttgctttgagtcagagaaatatctgtctttaattttgttttgttttgttttatgatggcaaaatgggggtacatgattgtggcaacagttttgagacagttaatatttttggtgtaagaccagacagatgaagaaactgtctctgaagagaagggaccgaggctcctccctgcgtggcagcaaaaggtccacaacacatcactttgggtctcctgtcccaggagattccgcttccgaccaggcaggcttgccccctgagctcatcacagcgtgagtctgggttcacattgcccacactggagcatgggctgtgaaactacaagagaaaaacacctcacagcagagagcccacgtgacaagcacacatgcctgacgggcacgggcgtctctgcagcaggctcaggcagtgaacacgcagacccttgcttcctctaaattcacagggctggccctcaggtatgcgtaacaaaaagaacgccagttcccttttcctggagaaaatacaagaggttccagagccttaatctacaactccagttcaaagtttcaagtagaaggtggagagaggtgggaacattctatttttgaaggtttccctataaaatctgttacatacatatatatgtatgttttttggtggtgttattgttcagtaataccagaaatgcatggtagaaaactttcaactataggagtccaagattaaaaattaagagtagccctaaagccccatgcccatctgtagacgcactctctagaaataaccacagttactaatttcttagttttttgagctagcatttcaactttaaataacagtcccattgctatttcttagatcaacttaaaatcagctgctggctccctgctgtgaaagatgaagggtctggggccacatgggtccccctccactgtcatgtcccacatttcagtggaaaggcttccgagatttccccatttggtgtgaggtcgtgtcccagatttcagtggaaaggtttctgagctttccccattcggtatgaggttagctatggttttgtcatcaacaggctctaccattttgaggtatgttcctctatacccaatctgttgagtttttgtcatgagggatgctgaattgtatcaaatgcttttccagcactgactgaaataatcatggtttttgttctgggttatatccatgtgaccgatcacatttattgatgagcaggtattaaaccatccctgcattcctggatgagtcccacctgtcatgctgaatggtctttctaatgtgctgctggcatctgcttgctggtgtcttgctgaggacttttgtgtctgtgttcatcagagacattggcctttagttttctttttgtgttgtgtccttgtctggtttgggtatcaggtaacactaacctcactgcttgagtttggaagtatccccttctctccatttgtttggattagtttgaatataattggtattagttctttaaatgtttgaatgatccatcagggcctgggctttttctttgctgggagattttttgttctgatttctacgtctgttcaggttctgtttctttatggccccaccttggtaggttgtatgtgtccaggaatttataaaatttctctaggttttctaatgtattggtgtatagctgttcataatagtctctagtgagcctttgtatttctgtgctatcagttataatgtttctttttccatccttgattttatttattggggtcttatcttttttttttcttagtctagctagagctttgtcaattttatcttttcaaaaaaatcagcttttcattgtgttgatcttttgtctcttttgtctcaatttcattcatttctgctcggatctttgttatttctttccttctactaatttgggggttggcttcttgattttccagttccttgtggtgcatcactaggttgtttacttgaagtctttctacttctatgacataggcattcattgctataaatgtccctcttagcactgcttttgctgtatcccataggttttggtatgttatgtttccattttcatttgtttcaagaaattttaaattttccctcttaatttcttccctgacccactggtcattcgggagcatgttgtttaatttccatgtgtttgcatagtttccaaagttcctcttgctatggtttctagtttttttgattgtgttgagaaaagagacttgatataattttgacgttttttaattttttgagattgttttgtgagctaacctatagtctatcctggagaatgttccacttgccaatgagaataatgtgtattctgcagctgttggatgaaatattctgttaatgtttgtcaggctcttttggcctagagtatagtttaactccaatgcttcttgttgatttttctgcctggatgaccttcccgttgctgaaagtggggtgtgaagtcccctactattattgtattacagtctgtctctctctttagatatattaatatttgctttatatatatcggggtgctctggtactgggtgcatatatatttactattgttatatcaccttgctgaattgacctccttttgtagccctcataaggcttatgaaaaacattcagtagttataacaagttattaaaactgataccaacttacctttgattgtaaaaaaaagagacaaaaccatgtacatgttaactctcttctcctcccatattttgaatttttggtgtcacaatttatattttgatattgcctatctcctaactaattgttgtggttattattttattaattgtgtctttcattcttcttacaaaagatagaagtggtttacacaccataattacagtattagtatgacaatcacattagcatccttttcctttggtttgaagaactccctttagggcttcttgtaggacaggtgtggtagtgatgagtctcctcagcttttgtttgtctgagaaagctgccatctctccttcatttctgaatgatagctttgctgggtacactatttttagttgacaattgttttcctttagcactctgaatatatcatcccactccctcctggcctataaggtttctgctgagaagttgctgctaggtatattggatctccccaaaatgttgtttgcttcttttctcttgctgcttttgacatcatctctttgatctttgagagttttttgattatagtatgtcttattcttatttgggttgaatctgattggtgacctttgaccttcctgtacctgaatatttctatctttctccaggttggaaagtttgctgttacttatttgaataggtcttcttctgccttgtttttctcaattccctttttaactctgatagcttgaatatttgttcttttgatgttgtcccatagatcttgtaagctttcttcatttcttttcattttttttcttttttcttctctgtgtattttcaaatactctgtctttgagctcactgattcctccttctatttgatcagttctgctactaatgctctctctttcatttttgcatttcattcactgtatttttctgctctaagatttccatttgattttttctattacttcaatctgttaactttctctgataaatttgtaaattcagtctctgttttcttgaagttcattgagcttcctgaaaacagctattttgaatcctttgtctgagagatcacacatctccatcatcatgttagggcccgtctctcgcaccttattttatccatttcgtaaggtcacatttgcctgaatgttcttggtgcttgtggatgtatgataatgtctgaatcccaagagtcccacagagagacttttgactgtgcataggtacagaattcttgttgttgtgggaaatatgagcaggttaccttcaattccaccactcaataaactaaacatagcattaccatatgatccaccaatttcactcctaggtatatacttaaaagaattgaaaactggtgtgcaaatcaaaacaaacacgaatgttcatagcagcactattcacaatagtccaaaaaggtgaaaacaacccaaatgtccatcaacacatgaacggataaacaaaatgtgatatgtcatttgtggctgccaggagatgggaagtgattacttaaaggatgttcttctggggtgattacaaagtgttgaaactagagagggatgatggctgcacagcattgtaaatgtgctaaatgccactgaatcgtacactttaaaattcttaaaatgctgaatttcatgttatgtgtattttgcaacttaaaaaaaacatgtttacctaagtattgatagaggcaacattggcaaatgtgaatgtgtttagtacacatgcatcacattctacctgacatccttttttggagcaagaaagggtataaataaatacttcttttagagcttatatttaattgtattatttttatttatgcattttgttgggctataatatacactcagtaaatagagctcacacgtttagatatgtgcacagccacacagtcagtaccgagaccgaggcgcgggctcccccgctccagaatctcctctcatatcccgccccacctaaagcttagcactcttcagagttctagagtcaccctattcttacatctcagctcaacagaaccatgcagtatgtacttcatctgctgctctagtagggggttaaaggtgatgctattattctacctttcattttaattcatgaaatgaaataattttataagcggaatttactatttagtaacccatcagtgaagttcacacaggaaagtcaggataaatgcttgattattcccttttatttactgggttttcaaataatgacttggctacctatcatcctccattggtgaataatttggggcttttcagtaattttctgcaattattttttattgagatgtaattcacatatcatacaattcaccctttaagtgtaaacacagtggtttttagtatattcacagagctataaaaccatcaccactaactccagagaattttcatgacccgaaaaagaaaccccatacccattcccactcccatctcccctccctacagtccctggcatccattaatccaccttctatcactacagatttgcctgtcctgaacatctcacagaaatggaatcacacatgtggcctcctgcacctggcttccttgatgcagcctcatgttttctagatttttccatgctgtagtctcagggcttcactccttcctgcggctgattaatggagacttgtttatgtcatgcacacaccttcacatgcgtccactcacactcacaagtcatcaaagagctcaagcagcaggcaaggctcaggagaggcactctgagggacaggatgatgggcccggctgtttccaaaaccaggtggcttggggcgactcatccaacctctccaggcctcagtttccccatctgtaagctgagtggctgggcctcaggtgaccctgggtctctttccaactccacaattctgtgatttgagcaaataagtccaatcctgagttttgtctcactttctaatccagtaaaagttaagctattgtgtttacttgactcagcagagtgtgtgggggcagagcaattatgacataaaaccacgatcctctttggtactacaagctaatcaacgttaatttttcacacaacgactgggaaaatctgcctacaggaagatgccaccctgggtggcactggtgtgccgggagggggtgctctccaggtggccctggcggcatcggtgtgctgggaagggggtgctctctgggtggcctgggtggcatcggtgtgccggaaaaggggtgctctccaggtggccctggcggcatcggtgtgctgggaagggagtgcgcaggcccaccccggcgtgctgcctgggagtccacgttctcgaaaatgcagggtgaccctggcgcaggatcgggtctgagagctgctcaccgacccatgcctcctctagcaaatcgcctctctcacagtcacctcaacagcatctcagccgttgtccgacactgggtgattctgcacgcccggctcggaaccctgtgcattgcccatctgtgagccgacctcctgcctgaagccaccttctcatagcgctcagtactggggaccctggccgggaagtttgcacagagtatgagctctggctgaccatccatgtcctgggtacaactcaccctcctccgtgattcaaactgttccagcctggaataacccgattgctcctatgggaacaactgctcctttccagccaaatgacccatttcccaaacgccttccctttccattctctaaatactgtagcaccacactgactagcgtgcgggtctccaccacagttatgaccacccttccctcctcgtcccccaaagcactcaacagctctccagcacccaccgaatgaagcactgacccttcagccaggctctggagcccctacaagcaacgtccgtctgtgtccaggccgatctcgctgctccctcggacgtactcgccctacaccccagccaaacgcactccgtgtttgccaacatgtgcgcctttgaacatgcgttctctccgcctgcagtgccctcctctgtgtctcaatccttcccgtgcaccaggccactctgagtctgctcctccacgaggctcccagatcacccccaaagccaccacacctgtccctgagtgttcatggcgtcacagttgtcactgaggctgtggcacttccccttccaccaggcacagcagctatagttgtgtgcacacatcccctcctgaaccgagcagttctccgcagatatgggctgaccaaatgagcatctttagagctaactgggaactgtccaggggcgagaggcctgggtggtcttagtactgtcactcatctctgcttcagttaacttgagcaataaaataccctgcagataaggtcagacggcaggtgccagtgtgtcctgaaaagccgcaagtctacaagcagccggcaacctgcccggctatgctgtgtgcatccccacagggcgccaggagcaaacacccaaacacccatcctattcccgattcagggcaatggtccaaaagacgccatcgctgctacatgagacagaacgtcacagcgaagaggcaggcagcaaatagatgcctcagggcgtttctcaaagaaaggcatgatgcagcctgaaaaccccaccagaagtgtcttcctgaagcatctaaacgccctctgagttccttctcccagaagagagcagttacatgaagcagcaatcacagaacggaagtgcccggccacaaaggctgccgtccttctcctcgtcccagtccatcttacagaatggctcccctctgcagggccacacagttgcccgggatgcagacgctgagacgggagctgatgtgcaggtttctagggcaagaggcgggagagagtgggcagccgacaggacgggggacgcagcctatgcggagtggatgcctcaggaaggccctgcctgggtctcaaggccccaccatggggtcttgtctcattcgtgaccctgtgcacgccgtgcagcagtgcagacggccggggccccaccacagggggtccagggagaccaccagcgagagagtggatacccctgggaacaaagcgggcccagatggagacctcagacaaaggcagctctcagccctcagctgagcacgccgaggggctacagcccccatccaggcccaggccggctgccagcacagagaggcccaagtggaccccagggccaaaaccccaagtctgggggctgcaggggagcacggcacctggctaaagacacagcacacagggctacagcgggcagcctgtggtcaacagctcatcagcgacgagccaggcccagccaagacagcaggaaaaaaaatcaaacgggaggccatgccctctaccctgggggcagagctgagaggacagagaacaggcggacaaggcaacagggacccaggtgcgggtcagcaggcgctaaggatcccagggtctgcgtgcccagccaggcctcacaccagcgacatccaggggtctgcaccagagccatgggggaacagagacacgaacaggtgaaagttcagcagggctgcaggcgcccaggccagccctgaggcagagacgtgaacaggcgaaagtgcagcagggctgcagccctgagacctggtgggctggggtcaggacgttaagggtgtgtgtgtgtggaatggggctggccggccccctcccaacaagatgtaggaaaccccatggccgggatgaggggaggcaggaagggcaaggggcatggaggccggctgagagtccagaggagagaccagcccagacccagggaagaaggaaccccgtgggatgtcccagacagcaaggagagaggcagtggaaggcacaagggcgggagaaagacctcagaagggatttaaagaatgaagaaataaaagctctgaaatttattttaacagagctttgggctacactctaacctttgcttcagcagcacaagaaaaagaggctgcacagagtggccccgcaggccagaaggcagcaacgcccactgatgccggaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacccctccttttctcaaggtcagaacagcagtgaaggtcagagccagaagcacagcagacgctcccaagccacaggcagctgctgaggcctgagccggggacgaagctcctccctgcatggggacacgcggggctgcagccactcccaggcctccatcacacagggacggtacagaaatagcgtgtcttgtgggtgggtgctgggtcggggagggagggcgactgcctctccctttccaggcacatttggattccccggggtgtccgggaatgactcaggcctctggtcagcgcttctcagacctgtgttcacacagcgcgtctccctcctttccctccctgcctgggacctaagtacggctctgtttaaaactggcccaaatgcagggtcagcgcctgagatgcagcccccacagcagcccccccacagcccccccacagcccccccagcccccccacagccccccacagcagcccccccacagcccccacagcagcccccccacagcccccacagcagcccccccacagccccccacagcagcccccccacagccccccacagcagcccccccacagccccccacagcagcccccccacagccccccacagcagcccccccacagcccccccacagcagcccccccacagccccccacagcagcccccccacagccccccacagcagccccccgtagcccccaccccacagcccccccacagcccccctgcagccccccacagcccccacatgctccactcgatgctcacacgcacagttttatctccttaactctaatgctgtttaaaaactattgtcctaatcaagcaagaaaaactgcaggtttgcaaagcgtctgctctggaagagcggcaggccagggtggagagaccacactgccacacctgaacacagcaaggctttccaaactctgcgcaataggaagacgccgaatggtaaatggaggagctcgcaggagacgcagctctgactctgccccgccccggcccgcggtgctgagggcgcgccgatgtggatgcctctgtgccagcaccagcggctgcccctcggccccgaccctccccactgcgtcctggggcaccctcagagcttcggccatggggtgcacagcaccctccaagcattctgaaaggagattttagactcttgtgcgcaacacccaggagccgcccgcctgcaaagcacttggtcagcgtggcctggaaaggggaggaaggtcctggaggcagggctctgtcaggcggaggacgtgatgctcagagcagccagggacccccgtctgggcccagtccccctgcgctgcgccccacggctggctggaagtttgttctggaaaccacctccaagacaagtgcagcagccggccctagcagttgggaagaaggcggctgacgtggcttccatggaaaatgccagaaagcacatcccacaccaggacacctgggcaaacagcctcaactcggaaaatcccaggctggttcggtctctctgctgcccggacctgtttaaatgtccagccgtttgggaactgtgtacccttcgagaaacactccaaggccccagggacaccggaagccgtggagcccgggccccatgcgtctgtgttctcgccacctggagaggctgctagtgactgacaggtggactgcggggcctcaactgctactgagaatgccacacaattttaaaaactcagaaattgcttatttttagaattttccatttaacatttttggaccacggctgaccacatgtgactgaaaccgcaggtgagggggtgagcgtcagcctgtgtcaggctggacacacctgggggcctgaggagcagccgggggtgtagggacaggggctccccacacccacatggatggcctgtgcagtcaccagcaaggcgggttctgcaggcctgtgtcccggccaacggcagccaccaaacctctctgcacttctgttacagacaagtcagagaggcccagaaaaagggaccaaaattgaagaaccagggaatttcagagggaagggaagggaaaatccaactggcaagcagacccctgggccatgtgctaggaaggggttctgcccagcgaggtctacccccaaccaggacgggtaggcagtggccccagcaccccctgcacccccacggcccaccaggggactgcacctctacaggaaggacagaggcaggaggaacccctcagggctggagagttgccagccactgcccgtgctgggccccgccctgagacagtgtctaagcaccaccccatggacaatccgaacctggaggggcctgatcccggccctgacccatgccaggggccccagccggcactgcacgccggagatccgggctttccttggcaaacacgcttggctgtcctcgtttccaagtcagccctgttggtaaaacagtgaagccagcagtgaaatacacgaaacccgaacagccccggagttggaactggaagcttccagggaagacggcagtgtctaagtgtctcccttaactgctgtggctgcacccggggtcctgggggtgagaggcttgtgggccctgaagtcacctgctggattccaaagtgggccatgccaatgccgtctggaaaacatacggaaaatgtcattcccaggaaatgtggcacatcattcaccctggaccacggcacaaggaaatcaactcaccctggaccatggcataaagacagacggggccctctcatcagaaagtggggagcgggggtctcagtttccaaggaccccacaagcgacgtctacagggtgaaagaccccgtgcccagcaccgaaggacctgcccgacacacagtccccagccttgagcggagacccccagactgcatacaactgtgcaaatgcacttgacctccctttggttgtgagtcacaggactgtcttaaaaagagtgtcttcttccagtgccagaaaacagagagacgggggctgtgaagcacaggatccacagcgggcgggtggtaggcgggcagcaggtgggcggtaggcgggcagtgggcaggcagcgggctgagaagcagagcagagccccagccaggagcccagagggcggcagagcagcgggcaccgaaccagactgtcggacctgtgctgggggagagcgagagtgaaggaggaagagagacggagacagagagacggtgagagggagagggacagagagggagtgagagcgcttcccacaagaagaaccaagctcaggtcccaccctcccccagagcctggtgcagctgcgtgggacgggcaggaggtgcgaggggccctgtctctgacgttttgtgccagcactgccctctacacacaaactctcaggaaccatcacgaccccattttgcaggagaagatgctgaggcccagggcggtgagcaggccacatggccggtggcaggggcagaagtgggactgcagcccaccaggtggtgtcacagccaaggctgcggcgtcactgcctgtcctgcctcacctacccccagggcgacgctcccgactaaaccacctctgtcctatggtctccggggcttcctgacccctggggagggcggcaaagcctgtggaggctggagtcctgtgggctggggacgacgggaagaccaagtcgtctgtataatcgccgtgggcgcagccggcagtgccacccacccacccacaaggcaacacggggcctgagtccagccccaggcaggtgggctcccagagttggggtccctgaaccaaaccacccctgctgctcgctcacccctaagagtgaggctgcgatgctgtcagccaaggacactcacgtgggcagctccggtgcagccggccccagggggagaaatgcagctgtggctgtcgtggaggtggctgtggccaatggccgtgactgttgctgtgtctggcagagaagccaggtgcactggctctgtgcttcaaggagacctagagggtctcccccaagtccaccggaaatgtgtgcacattcgccctaccccactgtgtacctggcccaagtcgggagagatgcccaagagaccacagccagcctcagcacagtgaaggctgccctggcccttcggggtgtctgggaagagcctggcattctctctggggtagctctcacccttgcaaagcacagagaacaccaagagccccagacacacactacatccaaagggaaggtcgggcggctcccagacgggggacggggggacgggggacacagaaccaagccgccgaggagcacctgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgcgtccacactgccccggccacggacacccacccccgatgcgtccacgctgccacagccacggacacccacccccgatgcgtccacactgccgccggccacagacacccacccctgatgcgttcacactgcccccggccacagacacccacccccgatgcgtccatgctgccacggccacggacacccacccccgatgcgtccacgctgtcacggccacggacacccacccctgatgcgtccacactgccacggccacggacacccacccctgatgcgtccacactgccctggccacagacacccacccccgatgcgtccacgctgccacggccacggacacccacccctgatgcgtccacactgccacggccacggacacccacccctgatgcgtccacgctgtccccggccacggacacccacccccgatgcgtccacactgccgccggccacggacacccacccccgatgcgtccacactgccccagccacagacacccactggtgatgcggcctgagatgccaccacaccctggccagaggctcagtccacagcccataccccatgacctgtacccacaaaacctgcagctagcaagaaccggcctctgcctgaccctgtcatcaggggcgggaactccggtggcgggcacacccagcgcaattacagggcgagcatccgatgccctcctagtgggccggccacaaagcctctcatcagccaccccgtggagaaccacagccaaaagcctgaaccgcacaagatttggcgtctcaatggcaccttcagaataggagaaaatagcaaatcgaaactttggttttccgttccttatttacgactcaggacaagactgcctgagagagcagcagactccaagtgcaggctgcagtgcagtgtctgttctggagggggggctaccgcctccccagcccacacatgctcacccctccctccccacacacacgttcacaccctccccacacacgctacccactcccctccccacacacgttcgccccctcccctccccacacacgttcacctgagcattgcccacaccagcgtcagcagccctcacaggaagggtggcccccaggctctcggccccccgagcccagcttccatctcgggccataaacaccctttggccaattggcgcaccctcctccaacagactatgacctccccaagccccagaatccctggagatggagagcacgcctggcccccagtcagggcaggtagtctccagggccaagccgtcacctcagaagggtgggtggggctctccccaggaggagggcaggtccgggactgggaggacgacccccacgcaagcccccaccctgcccttgggctccagcctcatccccagcagccgccagccctctgagatgccagggtgccatggaccctgcactgaggggtgctcactgggcagccgtgtgaccagcaagcagaggcaggttcacagcagcagtggagctctccagaggcaactccaccaaggggtgccgcagagctctgtacccccaaatttatgaggagcccggctttgggaggggacacctaggggaaaagggctcaggaggcctcagccaaggaggagcagcactggcagcccccctcctccagcacggggacagggaccaccggcatcgaagctcctcacctgcctcctgcctgacaaggccacaggcacatccggggccagcactgaccagacgctccctccgcctcgcttcacccagcctgaggctggacgggaggcactggcgtctgcagcacatccacagcattccagaaacgacagaaaccaggccaggctctgagcagcccgtccgttgtcctgacacctgaccatgacggcatatttacggtgtcttctcaatctttgaaaaatatttttaagagaacatgagaacaaatcaatattccagtggcctaaggaagtcagctagctgtgaaactattacggtaagctacacagtgggggaatcagcgtgggggaaaggaagcgggcattccacagtgcaagactctgacacacagagcgtcttgcacccgccctgagctgagcagtcctgaccctaaagagctgccattcctctggggccacggcaggaaatcgcaggcactgagtgggaggaagaggatgaccgggtgttgggatgggtgcacatcgcagagcggcacacggcagcctccggatgggcgcatggcagagcggcacacggcctctgctgtcttttccgatgaactttcaataatacatagaaacatatgggtttaatgtttcctgtgtgtgtttacagatgtgtgtttaatattgaatatgtgtgcgcgcaccgtatctccacggagcaaaataagaatggagagaaactaacgcaaagaaagacgctaacgtgccaggctttcagtggggacaacttctcattcttgaaaacttaaaattagcttttccaaaacatctataaagcaacagaaatgcttacaaatttaacagcatttgagattattgtaaataaaaatgataggtctaatttttcttttgccaacatttccttcgtttatattgacagtcaactcattacgtgtaacaataatggcaatttttcctaatgaagtttaaacataaaatataaaacaatgtaattcggagctttgtaaataaatgcccattttacttagcgtaggtgtagaaattcacacccaagtcccacttagaacacgcttcccgctccggagcataagcccctggcgtggggaggggttgggctctgtctgaactgatcaccaccactgctttattaattgtttttggcttaacacctgaaccagctgggtgcaaactatgacacacattacaaaaccacctgtccatcctccaggcacatggaaggcacacggcccacagaaaccaaactatatgctgcgtcccatttagaaagctctgcgtatgtttaaaattaaaagtcttataaggaaactatttttctgtattttaaaatgttcttaattacaaagaaatagatattcattctagccagttaagtctccaggtagaaaaagttaactcttttccctccctcagccaggcccccccagagccacatctggcaaggacggcttggtgtgcacgcccacacctcctctctcgtgcacggccacatctggatcagatgtgcaggcatttcaacatggcagtctccatccagccacggtctgcggacagcgttcaggctccagccttgaccctgggcaccttgaccctcacggggtacgtggcctgtgtgtctgcctttgtgtcctggtcctcgcaggggacaggcctgtgtgtcccacgttcgtgtcctggtcttcgcaggggatgtggcctgtgtgtccctccttcgtatcctgacccttgcgggggacgggcctgtgtgtccctccttcgtgtcctgaccctcgcgggggacgggcctgtgtgtcctgccttcgtgcaccctgacaccatgggtctgattttcccacgctggaggtctgcttctgaacagctgcatctcctcctgcaggggaagctgtctgttcacccaggtgcctgtcctgtctgagggctgggctcttcctacccaagggttgggggctggcctgtccctcatgacccaggcaggcggccagggctccccggaactccaggctgctgcgggtgtctgctctgccctgggtgaggctctagaagattcctgtggaagcgactgtgtctaggggagcccattccccagtttaaaggacgtccccccccatggctatccacatgcccagtcctctcaggaagttccaggctgccaggatcagaggaagcagaagccgctgtccttcagcaggaccctgcaaaagcaggatgaatcagcggggccattcagaacaaggttcaaattactgctgcacttttcagaatggagccaggctcagtgtttcagaaccagaggctgacgcggatcagctcgcacccagcctgggacctgagccagcccctgagtgccactctccacggccgcctcagagggtaagcctctccaagcctgcttcctcgccggcatggtgggggtggccctgccatcccctaggggctctgcgggatcccctgaacactacgaaaaacctgagccccactcctggccactgggtaaggacctctccgagcctttctccttcccattcactcccacccccaggcaggagcgaccagtgctgagaagtcctatcatcccacaacccatcatcctccgtcatcccctgtccgtcaccccgcagctgtcatcccccatcaccccgtgtctgtcaccccgcgtctgtcaccccatgtctgtcaccctgcatccgtcaccccgtgtctgtcatccccgtccgtcaccccatgtctgtcaccctgaaaccatcaccccatctgtcaccccacatccgtcatcccgtgtccatcaccccgcgtccatcacccccatccgtcaccccatgtccgtcaccccatccatcaccccgcgtccatcatcccccatccatcaccccccgtccgtcatcctccgtccatcaccccacgtccatgatcccccgtccgtcaccccgcatccatcaccccatgtccatcaccccacgtccatcaccccatgtccattatcccctgtctgtcaccccgcgtccgccatccacatcccatcaccaggtgctgttttcttggtgctagagcaaggtgggattcacaccttgtgtgcacagcttctgagtcactgggcggctgggcacagcctaactcaggagcagggacccacggagggtgtggcgacgacacagccctcagcttgctctccaggagttcttctgatacctcgaggacactctggaccctgtgtctgggtcccagcccttccgtaacaacgtggctcctctgaatcagtcacaaggaagatccaacttaacacagagagtttttcccaaacagcagaactggcagcaacacaggcatcctgcagttcagtccactgcatgcagcgtgcaggtgtcggagggcgaggctgccgtgggctcccggcggacggtggcagggcaggcccaggtctctatcacagcaaggcctctccactcggccccctccacctgtttacaacctcaagctgggtcaaaaccccaggggtactcagagggagtgtttctccccaactggattccttaagccagagggcaggcggcagggtcctggcctgacaaacacacacgggcccccgaacacgaccggctccgtgaccgtcacaggacgttcaggtggcttcattttcagtccacgcctctggtgccagggtcttgcttggcacttgtgtgaacggcgaccacgtgaagcctctgtcttgagaaaagtgtaaacagcagctgcctttcaaggcactgaggccttcctcgaactcagctcgtttgtgctgcgtggttcccagtccaaaccctcctgttcacagcctcctcttgcctcaagcatcttagagctccactccaatccacaccccagctgccttttacaaaatcccaagccaatgacagcttgaaaataaagtgagaaaaacaccgaccaacatttactcagcacctacggtgggctgcggacgttgacacagggtcctctctaatcttccatacagatcagccatgagggccgcggagaggagaaaagcacagctgagctgttttctcttaaagcaacataaacgtcaaagcaaaactggagcccaggactctctgacttaagctcatcctccttctgctccatcccggctgtgcacacctggagaccaggccctcgagcctccaaacgccgtgagcagcctcctcctgctgtggcttccaaagagacgtcaccagaggcggggctggcgcagggccacgaggcaggcgactgggtctctttgaccgggggtggcctcgcggcggcacgagactcagcatcgtgtgggtctagctctgggaatcgaggcagcccccagaacacccttggggcgcaacttcccggtgaacgtcccgtctcctcagccacccacagatgctgccacagctgcaccctcagggcaacgagcgtctggcggagcccagtgagagccgtgaaacacagacctcagggccaggccctctccccatcacagaaacctgaccagtcacaggtggctgcagcctgggtggttggtaaaagaaaaattattccttctataaccagaaaaaaatagtgaatcaacagacacagaaatgctcagaataaaacaaaaaatctaagtcagtgggacagaattcagcagtccccaggggggcctggaagctggacccctgctctgggtctacgggcttacatggctgccaggaccagggagagacagacccgggcccctgaccataccctgtgctgtaacgcctgcaaggtagattttaagtaatttaaaaattatcaaaaggataacatttcatgcctgtgaacattacgtgcaactcaaatctcagtgtctgaaataaggtgaaatggatacagtccggctcactggacggcaccgtgcctgcggctgcttccctgcacagctgcatgacccctggccctacacaggacaggttctgcgcactcggccgccaccttccttacacggcttctcaggaaagcagcaggcagctgtggcccagcgtgagccggcaaagcacttccctcccagagccccgtttcctcatcagcaacaaacacaacaagcttcctcccctggctgctgtgaggaccgacagcccctcctggcacctgcacagggcatgacacgcacatcacagccgccttcacccgctcagcctcccgcgtccccacagcccggaccggagcctcagagcaccaggacacacccatccggacaccggcaggtttgacaccacagactgtgcttggctggggagtgagaatcctcctgagagagccacggtgtcccaggtcgggggcagcagagtgagggtctggccgtgggccccggtcgggggctgagccacgctctggtcaggaaagacatcgccagacacctgtcataatccagggctgctcaaagtaaaaaaaaaaaaaacctaaaactgcaacatggaacggcacaaacgagctgcaggccgagttctaacgggctgagcctcaaaccagctgcaggccgagttctaacgggctgagccacaaagagctgcaggccgagttctaacgggctgagcctcaaaccagctgcaggccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagcctcaaacgagctgcaggccgagttctaacgggctgagcctcaaacgagctgcaggccgagttctaacgggctgagcctcaaacgagctgcaggccgagttctaacgggctgagcctcaaacgagctgcaggccgagttctaacgggctgagcctctaaggagggaaacgtcacttcctgcctcacacagagcccagcgtctccatgtccactgatagccttggtatttgcaactatgtccatgaccatctctgtttctccaaaacagcctctagctacataaactgtttagaaaacctcatgcgtaaagcagagtatgtcaaacctccatctgtggtcaggagttaggacatccccagctgcaatttgagcaaagacggcgcttccagaggatcatcggatcctgtgtcttggttggggttggggcccatcaacttaaaatagcttctgtttatgctggtgaaggaggcacagacttcaccctatctaattccaaggaacaggcgagggtgggagctgtagcggaagagacaaaagcaaaaggcagattcgcccctttgtgtggtcccgtaagtgacactgtccctccctctccctggaaacagcagcccccaggcaccccccccagcaactgggacaagggcacaccaggctaatttttaatcagatggatttagtgatagcaaataaagagaaggagaacaaaaccctcagccaggctattgtgaatgggtgttaccaaaaaatggcattagcagggcaccaggggccaggccagctccaggcagccccgcatctgctcagcaatccccggagtcttctagggggcctggggcagccggaacctggccgggtggaggatttctaccacgagaaagtcagggccctccccgaaggagcagaagctctgcgggtgactgtttgggaagctggtctgctcctgatactctgcaggaagagaatcacactctttagaccggggtctcagatttcagccggacgggaactctctgcagggccggtggaaagagatcgccagccccagctctgtaggggtgcggcctgcctcgagcacttcacacgcgtgcccggggatgctggtgctgcaggtatggggaccccgctaggagagccccgggttaagggttggtaactggagaatggggtgggggtatgccagctctccctgcttgccctggtcccacacactcaggcctgtgtggccagcgtggtcctcctttcccacagccaaggtgccccgactgccagcgtccactccccgtggggccgcagggtacaccaacatctgaggcagaggcaccgctgtgggctcatctctcagctcaaagggtttccaagagaatcctcagcaaaaaagcaacactcgccgttcagagagtgaatgagaggccagcagggggctgggaaggtgcttagctcagggagggctggagggtgggactaggaggcactaaaggcctgggggctcagagaaaggcccagcccatcccagcagaggccgaccaggactccagagcccgtggaggccctgccatgcacgggaagcctttcccgacttgggggcaggagctggagggctgggatgatcctaaggggatgctcggccataagccacatgccaagtccagagcccaacagctgctgtacctcctgggctgtttccacggatgaggcttctctgaatgtaagtttgtctgctcagccacaccggcctcctcctggcacatcgtctctcacaggcacctccttccatggagactgggggcctcagacggctcttcccgacagggccctgcacttgggcagatgcacctgtggcttgagctcagcacagcacatagtggctggcaaggaacggaaggagaattggagaaatgtatctaaaatgtcaagcagacctctgctacactcactgggaagaaccatgttgcttctgacgaatttcttaaaaagagagaaagatgccaatgagaaaaccagaggggacaaatgctacccgggaatgtaaaacagttgccatcagagactggctggctcacattgtgtccaccaatccacccaccacggcgagtgatgtccgtacagctcacaccgcatccatcaatccacccaccacggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtatagctcacaccgcatccatcaatccacccaccacagcaagtgtctgcgatgtctgtagtgtctgcgatgtctgtagtatctgcaatgtccatgcagctctcaccatgtccatcaatccaccccaccacggtgagcgtctgcgatgtccgtgcaggggagagagacctggcctatcctcagcacagcccatgtgacgttagaaaggcaaccgcaaattcagctgcggagtgcaaaacgaatttcctcctgtcacacgctaactttctgttctggatttcctggggtttcctttattagacttgagtccagaactcctctagaaacattctctgggatatcttgacctggcacgcagaggggtgaaggaacggggacacggatggatggagggagatgaactaatcagcaaatgctccttgcacatttcctagctctgtcagccaaagtgaggtctgaccacaaaagctacccattcacttgctaaatggtgcaaaatgggcccagaccctcattttacctttacttaaataacagcatattctcgtctggtctttaaaccacacaggccaaaatgagttgagcactatcacatatttaattgactcgtaaaagcaacttgtttttcttcatccttcgccgacctttgtttatgggtaacccttgataacatgtgggcagggtttcagtgtaaacccgagggcaggttaaacacgctccctccaaagcttacttggctttgatttttcaaccacccgccctcatgtgcagggacagggcagagtcgtgaccaacagtggaaagacccatagctcccagctccagggacgacgcgggggtgctaagctggtaagctgggaaattcccgggcacgacccctggccgtgggtgaaagcacccccagccccacccccagctgtgagatgctgcaggttccccagccccacccccagctgtgagatgctgcaggttccccagccccacccccagctgtgagatgctgcaggttccccagccccacccccagctgtgagatgctgcaggtcccggcaggagaaggcttctccacagagaggccgctgaacaaggcacagggccaggtctggccgtgtaaaaatacttggaacccatggggggctttgtgtgtggtgtcatcggcagcttccattatgtccagcggtaacatgtttacggtccctgtgccgccgtgcggtagcagttttcccgagtgtctcctggctgggacggctggtgaggatgtgagttcaatagatgaacaccccaccttggtgacacagaggctggacagtcacaccgacccttggcccgggcgaggccacgtgtcccacaaaacataaggcttgggttagtgtcgggcacgcgggggaggtgcctgcctgcgtgaagactggtcacaagacaacttcccagtttagaaaatggttaactgattcattaatactcacttcctgtcgcaagagactcatgccctagagataaagccgtcggaggcagagtgcaggcctcgaagcagctggtcatgtccacgccctctgcaggcctcgtgtccccctcgctgtcgcctgccgatttggtggctcctctcataacacacagcctcctgtgtatgtttttaccctacaaacgctctctaaccggtccagaggtcagaaacagccgcagtctcctacctctattgcttctcaagggaaaagcacagcctggaatgatgaggagcccccacgccttctcagtctcctgtaacgacgttgctacagatgtatgtgtttgtgtgaagctgtatttaaatgtgagattattcttcttggttaatattttactttctgtcataaccagcaggcttaaagaagaaacccaaacgctctgtgaatgggacatgtgctcagaggcgtctgcagttgaggcgggtgacgttctggggtccctgggaagttgtcatcaccctgctgacatgagtgtggatgttgaggcctggagggtgacaggtcacacagccagagcctggcagcagcgcaggggcggaaccccgggtcccctgtgggcctgtgccctctcggccagccttgcaacgcgcagctaacgctcttcaagaaaacattctctggaggaatcctgctggtcctgaagtttttggccttgagaaggtcatcacagacacccctcccctcgggccaggcctgctgtcttgtctaaggggccctattttatctgaggtgatttgcaactctgaaacacacatacataaaatagaaataccgtcctcactattaacctagagacccccatccctacccctccctatgaatgctttttcataaacatgccgcattctgaggaatccgaaagactccagcgtaggacagaccgctgttccaagccactgggaaaggggaaactggtgactgagcggcgcccgtcagagccattaaaacgtgagggaaaactgcaccttacggcacacgaacccttagaagaggcaaaacactactgagttaatgcttaatttatttgtaatgataaaagtttttatcactttaaataaagttatttgaaaaaagttattcaatggcagcctaataattttgcttaatgaaaaattaactctgcaaatacagtttccactattcacatggagcctgcaggtttggagaatcctctgcatcagtgtgggtgagcacgtgtgtgaggggtgcacgtgtgtgaggggtgcacgtgtgtgaagggtgcacgtgtgtgaggggtgcatgtgtgtgaagagagcacgtgtgtgaggggtgcatcagtgtgggtgtgcacgtgtgtgaggggtgcacatgtatgaggggtgcacgtgtgtgaggggtgcacgtgtgtgaggggtgagcacgtgtgtgaggggagcacgtgtgtgaggggtgcacgtgtgtgaggggagcacgtgtgtgagggatgcacatgtgtgaggggtgcacgtgtgtgaggggtgcacgtgtgagaggggtgcacgtgtgtgaggggtgcatgtgtgtgggggtgcacgtgtgtgagggatgcatgtgtgtgaggagagcacgtgtgtgagggatgcatgtgtgtgaggagagcacgtgtgtgaggggtgcacgtgtgtgacagatgcatgtgtgtgaggagagcacgtgtgtgaggggtgcacgtgtgtgaggggtgcatgtgtgtgaggggtgcacgtgtgtgagggatgcacgtgtgtgaggggtgcatgtgtgtgaggagagcacgtgtgtgaggggtgcacgtgtgtgacagatgcatgtgtgtgaggagagcacgtgtgtgaggggtgcacgtgtgtgaggggagcacgtgtgtgaggggagcacgtctgtgaggggtgcatgcaatgctcctgtatgcacatctgtgggtgagcacgtgcgtgaggggtgcacatctgtgggtgagcacgtgcgtgaggggtgcacatctgtgggtgagcatgtgcgtgaggggtgcacatgtgtgaggggagcacgtgtgtgaggggtgcatgcaatgcttctgtatgcacatctgtgggtgagcacgtgtgtgaggggtgcacgtgtctgaggggtgcatgtgtgtgaggggtgcacgtgtgtgagggatgcacgtgtgtgaggggtgcatgtgtgtgaggggtgcacgtgtgtgagggatgcatgtgtgtgaggagagcacgtgtgtgagggatgcacgtgtgtgagagcacgtgtgtgaggagagcacgtgtgtgaggggtgcatgtgtgtgaggggtgcacgtgtgtgaggggtgcatgcaatgctcctgtatgcacatctgtgggtgagcacgtgtgtgaggggtgcacgtgtgtgaggggtgcatgcacacacacctgtaagcatgtgtgtgaggggtgcacgtgtgaggggtgcatgcacacgcacctgtgtgcacatgtggatgttgccgtgtgcacgtgtgcacaccaagtgtccgtgagtgcacgggaacagccgtttagaagtgccttaatcttcccgagcacaatagtagctcacctctgcaaggaggctgaaaattctcattatgagtctcataaatacgtggccacgttcatgggtttgtcttatttatcccttactctataataacttggaaggcacagccaatatttcccttatatcctgggacagccccagttcatggctcccgacgactgcagctgcctcctgggaaccccaggggggcaaactcaggcccacccccgcctgtgtgactcaaaccccccagccaagtgcctgtgggaggacattttagtgggtggggaagcttctgaaaaatcactttactctaactaatatttgtaattaacacatcaagtaaaactaaaagcttttgccttgccgttgttgccttttggtgggtgacctcaaaaagtcatccatctcacactgactctatcacatcccaactctagccccaaatcctaataaacacaccagttaagaatgcatggcacatttttacaagcctcacaactttctgattagatgcatagaaatgtcccaaatatttctgaaatattttatttgaaaaccgatgtcaccgccacttttaagccacaggcattacactaaaatctggactagcgtctaagcaagtggcagcttttgagctccgcacactccgtgtgaccatccacaaatctatgatgaattattaaccagaccaggctagcccactgcctggccttctctgctgaaagtcagcagctgtatcctgcctgaaaaacaccagcattcttgtgttcataaaacccgctggttccagtgcagctacccagagggaagccttgggtgtgggcagcgacaggggtgtgggtgccaccgtggggtcccccagaaggaaaccaggggagcacagaactaaatggtcacccatgacaatgaatcgtgatctggtgggaagaaatcaaagtgcttttatttggagatgaaattggctgcctgcccctccctctccaccccccgctttcctcctgacccacccaccccagctcttttccccggcctgggaagggcacatggagggcagaaagggcttccctaaagaaaacacagaaatacactttataaagcaaaataaacttaaaaaaaggcacttagcaaaaatgtagtgagaagtgttttttcctttccagtctttcattttcactcagcatttccataaacacattcttgggtccaaatgctgagaaactctttctctaaatactggaggagcgctaaatggagcaggaaatgatggagagagaaaggaatgccactgattccagacggatgggaccagctggggaattcaggaagcggtacggaggtcccggagacaactgctcacgcctctgaggggccgatcgctcaggatcccccagcagcagcgagagaaccagcagggcccccctcccctctccagccaggcgtcgatcagtgcccccctcccctctccagccaggcgtcgatcagggcccctccctctctccagccaggtgtcgatcaagtcctcaccttctctccagccaggcgtcgatcagggcccctccctctctccagccaggcgtcgatcaagtcccccccttctctccagccaggcgtcgatcagggccccccctccctctctccagccaggcgtcgatcagggccccccctccctctctccagccaggcgtcgatcagcgcccccctcccctctccagccaggcgtcgatcagggcccctccctctctccagccaggcgtcgatcaagtcccccccttctctccagccaggcgtcgatcagggcccctccctctctccagccaggcgtcgatcagggcccccctcccctctccagccaggcgtcgatcagggccctccctcctctctccagccaggcgtccatcagggcccctccctctctccagccaggcgtcgatcagggccccccctcctctctccagccagacgtcggtcagggcccctccctctctccagccaggcgtcgatcagggcccctccctctctccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagacgtcggtcagggcccctccctctctccagccaggcatcaatgccgttcaaggggtctggaccaacaagccctggtggagaacaatccccacagagaaactccgtgtgaccctgccccacagataacacggaaagggacttttcatggtcagaacctactgatctagaagtgatcaaacactctcttctcctgacttcctgtcaccaggcacgggtgaggaggaacaccagcaatttcttactaattacggctcaagcaccaatgtttgtccaccgttttcttctcacacagatctaagaggatcaagatgattcccagagtaacatctgtctcatttgaattccagtgtgcttccccgagtggcacagccgagctagtcttgggctctggaacagtccaaagactggggactcccctgtaacatgcagccacctaagagaacaggtcagtgacaagtagggggaaaagctattaggaaaaagaacaagttgtgggcctaaaaacaagatgtttcttatacaaatacaaaatactagaaaattgcacagcagttgccagaaaagatcccaagttgtggaaagtagaaaggcaggtgcatcccagcactgcggccgggggcaggaggccacccgcggggcattcggacccccgtgccccaaacacatcccgccgagcctcctgggaccaggcccctgagagccacggggctgtctggagagtgtccccagcctcagccatgtggggtagaataaaaatgattaagaactgcttgagaagttttaaactgcatgcagcctactcagcacagattggcccgtgtcttctgccacggatctcggctaaaggaaaagccaacagaagcccaccggagcctcccttacctccacccaacactgcacatcaagccgtgcaaccctgccccaaacggtcccagggtcatgggtgtgcatacatgtgcatgtgtgcaagcatgtcacaagaggagacctccgaggaacataaggatgcggactcctccctcagcctgaacctctgtctctcaggcacagctcgacctttgaccttcggcttccccagagaaagactttgaacgcttcactcctctgtagccctgaggacgcgggcggccagaccagtccctgagtgcggcaccatggccgtgtgagtttatggcccattgcgctagccctgtacagtgaatgagatactagttgtttacagctgtgagcatacacaggccccccgccacacgctcaggaaggagcttctcggaatctctctcctgcctcgcaccatgcagccgggctagcaggtttgtgggccgagtgcaggagcctgctcccactgtcactgcaggtgactggctgaggggcacacagggcccagaggctcctacctccagccaccgcccctaaactaatgaagattccagtccgtggggcccaccgcaaatcccagaatctcagcagtcagtcttggacattagttgtcggggagggagaggatctgggaggccaggcgtcccttccaggctgcgcagccggccacggcggcagagcttccccaggctgctccagccttcagggcccctccgcggtcagccccacccccggccagcaaggcttcctgagaaggctgagcttggcacctacagactgggggggatctggaattccccagaaaagccctcatcccaaagcccatgggaaaaccagccctgttggagcatcccacccggacctcggaggagagtccggcatggccagtcccctgggctctgcatgcagatggttttcccagaaccggttcctcttcctgaatctctgctaatggccctgtccatcagtctgaccccagccttggaaacccccatgcagcctgggccagaatgaagtaggcaaccagaggctcagggtgcttggggccgaaccacccccagctccaccacctccttcctgcccccgagccgtgccttcccccgctgggtgggcttgctctgcatctgggagcacctgggcccgggggtgcaggtgggttcgcccctgcccattggagggaaatgttctgacatggaagcagagggcacagcattcaggagaaccagtggggcctccacacagggggacgcagctaggaagggggtctccggccggtcggccccgagtgagggacgcagctaggaagggggtctccggcaggtcggccccagccctgactccaggcctgtgcatctcactgctgcccaaagcaaggaccactggctgccatgacagctgccacagtgctgagcaggcccagccaacgctgcatgagaaagggctctaggaaggaaaaggccgcggcagcacccagcctcctttctgaggaagcgattccacgagccacaaaagcgcctgggctgtggtcatcagagtccaccacaagacaaccttcctgggtccctacaccctggacacaccttcggtgcgtgcccggcatggagacgctcctgctgccggcatggctttggggacagcactttgctcctggagcctcagaggaggggggccggaaacatgtgtcctgcacagtcaccaccggacgccgaggtggccgccccagcaggggccatgggctgaggctggtcctcaggctcccagagcaatggctgctctggggaagagaaaacacagaagtgacaagatcaaggcaaactagctgctccagcacctcgagggtttggaaccaaaacaagaaatctccagagctgaaaagaagagtgaaaccttttccttcagaaggaacacagctaaagagaagatttaggggtgcacgcaagggccctcaggtactctgtgcagcccctcaaagcagggaaaaggccaggaatgaaacctaacgcagaaatgggaactggctccaacgccacacgaacagccagcctgggtctatcgcgcccagttcagacccgggctgcagcttggagacgatgacgtccaaaaaccaagctccaggaagacacaacaacaatcacccttaggctttgtcaggcatcccagagaatcctccgtcctaccctgggcacgccatgcgcaccaggcagggagggtggctctcagcaaggggctgaggactctggcccatcctggggcgagggaggcacccacggggtgggccatgcggggctgggagccacggcccccatgcaggtcctaagtggacatctgtctggtcggtggtcagaaaaaggatccccacggtgtctaggaaagactcagacctcttaccaacctctggaattttatcctatgggcagtcagggccaagacagatgattctttacaggttggaaattattcggataacataaaagaaacaatgtaaagaggaaagaacaggtgcaggagtcgttcctcgatcaattccaggtcaaggcaccggtttcggtccccagtgcggctcctgtctcctgacccagccccccggcccagcccccagaagcccggcacggtgtctctcgggacccaggacacgcaggtcagcgctgcagccgttactggctgtgttgtgataccagcagggcactgactgtccccagaaggaacaaaactgagacttaaatttgggtgattgttccaaatgtgggattcaagcttatttgaaaacgaaaactaagaatgccaaatttcagggtggctagagctacagccccaggaatccagccctgtctgcagaaacacacctaatattttcagacactcatagaacaaggaactactatttttgagaaaatactcacagaaaaacaaaatctcccagacactctgatgccgtttgaccaataacccatggggaaactcacttccggggatccaggcccgacgagggcgttcccgggcacctcggtgactctgaaactcatatctacagcaaagcttgaacgtttgtaactgttcactttggactctgcgtcacacccagagagaccctgaaccatctgtcacaggtgacgtaaccctcagttccccttcacctgtgccagagcctcccagacacaaaggctggagccccaaaacctgtcaggggcctctcaggggccagccacaactcactccgcctgtcactgctggacgcccgctgcggcctgacggagccgctccttcacctgtccacatgcatttcccacacagcacattgtcttgaatgaaggcaagttattttctttctcggccttggcgtcctccacagccgacactgttcttgcaatctgtgaagggatgatttctaagctccgcctttgttcttcactcactcacccaccgtatacatagttgcacattgatgcataatagacatatacttgctgctacggaaggccttgtattcctgtctctcttcctaccacagcactcctgccatcccacaggtaatccaattagcaggctgtgtgggtcttatccctgatctgcgcacactcatctgatctgtgtttatcattcttctagggggtggtgttgggcgctctcattttgcttcttttgaatcttatgccgtggaacttcctgcgagtcatgtggtttggcctgggcttaatatgttccttgaaagccacagagcagcccacatgtggatgcacatgacataatcaccgtttcagttggcgattactcattgggctgttcttgcattgctataaagaaacacctgagactgggtaattcaaaataaacgaggtttattggtcacggtgctgcaagccgtacaggaagtatggaggcatctgcttctggggaggcctcgggaagcttccagtcatggcagaaggtgaagggggagcaggtgtctcacacggcgagagcgggggcaagagcgcgaggtgggaggtgtgccaccggatctcacgagaactcactcactatcgtgagaacagcaccaaggggatagcgctgagctgttcatataaatccaccctcaagatccagtcgcttcccaccaggccccacttccaacgacggggtgacagttcgacaggagattggtggggagaccccaactcctcaacattgcttctactgtttgctatttgctcactcagccactggccacaggtgctgctgcagtagacacgtctgttcatcgccttcacctatggttcaaagctagaagctctggttgcacggcaagcccctcctttcctgcgtgaacacagacccctgctctgacccgcggctgcgtaagacgagacgcgctcagtgagctgcctccccgacccccaccacagttccacaacggctgtccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgcggggcatgacaccacatccccacgggaccccgtgtggccccttctgtcaacccatcggccagaggcccatccacacgtcccactggcccctccagctaacttatctgggcccctcaaaggccaggccgtgcatctcataacaccagcccaacccaaatgattccttcccttcctgagacctcactctctcttcaggggcaagttcaaagctacccctcccagaccccctccaagatgacagccaaaaccaaagccacctctctcttcaggagcaagttgaaagccatccctcccagacacccagatgacagccaaaaccaaaaacaaaagccacctctccagagtgtgagctctcccggatctcaacaccctcctacttattaaagtgtagctctttttcaaattatatatttgcttacatagaagtccagttcattacagacgaacagatagcttcaaattctgctagaataatacctcccatctatgaagatctgagcgggggaagtgcctggtgcatctaagtcccattaatctctgcaaaagaaggccttggcctccactttcacaaaccaagaaaccaaggcagagagaggttaggggtcatctaaaatcaaagaattgtcaagaaacgtggccagcacgcagtctcgggtgtctgattccaagtgggttcgctacgtccacgtctcccccgagggcccccaggagctctcctcctcaccaagcccctcccaccatcgctcagcagccttcactttcaaaaccttagcagccatcactttgcttgtggctgtttccagccaatacgtccacctcctttctaaacacacacacgtctatgtttaaaacatgacgcgccacctgcaaacacggtgccacagcctcagggagacgccgctcatccactctgcgcctgcgcggttcacacgctccttagctccaaatgcctcatttgcttccattagctccaaagaagcaagtcaaagtgttttccaccaatgccagattcccttccaggaatgacgcccccagggctgcctccggggtccacactctgcccaccagtccagcaccctggctgagtccacctgccaggcaccatttgctcacacacctgaaggctggatgggtggctgtggccctgcttaaaggatcacctctgcatctccaaactgtcttcccagcacaccctgtgtcttgggcctcccaggccactgtccacccacacagaccagcagccccttccttccttccctgcctgaacactgcctgcctcgtgtccctaaggtcaccaacaagtctctctgttctccagccctccatgattccccccattccaatccaagatcacagagaagaaacagctctccaaactgacaggcaggctgcagtggtgagcacctgtgtcccagctactcaggaagttgaagcaggaagatcccttgagtcctggagttggagagttggagaccagcctgggcaacacagtgaggcccagtctcaaagaaaaaaaaattaatggacaatactaagtggtgaggagaagaactcggatcccaggagcccgtggagctggggtgcttgggcccagataaatccgtgggtctccctttctccacctcagtgccgtggagtttccagagtttagataaaatgagataatacatggaaacgacgcccttagcatctgcatccagcctccacacccacacacgcacaagaaacccactcccctttccaggcaaggcccgggccccaggctgaacctgcccctgccggagcccctgctgtttcccaggtgcagccaggccctgcaccttcgtcctcaggggttaaaaatagcacaggcagcttagctgagctcggttaataaaatatccaagttaattttagcattaggggaatctaggatctctgatgccaaggcccatgtgtggccacacagcccctccttacactgtcagacagacacggggaaagccacggcgtggccagtatccctccctcaccttcacaaaacacttctcttacctgagtgagccctagccctctgaagacactgttgctactttctcttattaaacagaccatcacctaatttgatgcctgtaacagccctgtgaccagcggcctccacctcccgtgagggagtccatcaggctgagagtgtcagctgccacttctagcagagctgggcccggagcccttaccttctagcccaggagctggggccagggaggcacagtccaggggaccctccaggcaccccacttgtcattctccctattctcacccggtgccacctcctcctgcttcaggtgggattctgtttgtgatcaggagagggatagctggggctggaggccggcagcccctggccctcactgccccacaggcctgcaggcaccagcggttcaatgttgggccagaccggccgtgggtcttcttcacggacaagctccagcctcacaggaagggagcaagagcccagcggagccacaggcactgagcccagaggagaaagaagggagcgaccagagagccacaggaagccccagcggggagcccacggcaggcccggcctcccacggacggcattcccggacgctgaccgcctccagctcgacggcagggtcaccgcggtgcgagagcctttcccgccctggaccgcggggctggctttttttttttctgtaacagattgagagaaacaccttgtgtgttgctctttattgaacacatgtatcaagataaggcgccacatttaaaaacaagcagtaagtattgtggaaacggaagacatcactgcgaggggaggaggcactgcacgccttgggggcgggggccccaaaacaacgccgtggccgtggcggaagtgccctccctgtgggtccctgactcatggaaagtccgaagcacaggcttcctcaaagcagcgatcgcataggaagtgtggctcagtcatgcatgatacacagactctactgtgaaaggttaatgactgtttcaaaagacacagtgtttaagatgtttaagtgcacagaaggacatatccaaaatgattccacaaaactgaaatgcagaaagccagattcttcaagacaaagactccaaattgttaccaccaaagcacctcacttctacgtggcgctctcctcttattacctcacctgcaagagctggaaggacaaagaaagaggaagggggaaaggaggaagagattctttccatttttcccaatgtcaacgtctgaatgaggccacacaccaccacacatttcaaagctatttaagaatttaaatggccaatgcccctataccttaaaaaaagctcccaatccccccagaaatgtgctggctttttttcttagtaagagtagtagcagaattgcttatggtataactttagggacaattcttgttctgggagtgagggggcagggtgttaacttaaccctgaacaacactgccttgtacgttcccaccggatgtagtagacaataattgcctggcttttgcaaacggaaaaatgaggttatgaaggggaagacacgggccctgggtcatgcagcaagtcactggcagactcatgggcaaatccagcgctcctggagacaaggctcagaggtgaatgacagcgaggggccctcaaatcaaccacaggggcaccatcttgtctgagccttcaagaccagggactcaggcagggcaagtcagagccaaggttggccatgaatgtggattaaagaaagagcctgaggggctcagtggccccctggcaccagcgccgctcagggtcatcctccacttcgcttctacagatgggctttctgctggagccccggggtatcaggccagcagcacagttacatgagactaaccccaaaccagcgcacccacaggtcaccctcagggtctccagcccagactgcatctctgctcaaatgcaggaggtgccctgtctccccagctacttggggcacagatacccctcaggcagccagccctgcaggtgacctctggaggggagaggaaacggggacttcttgctggagccacatccagagagtcgggcagctggcatttgggcctctctacccgtcctcactgctgctgcccctgggagggtcaaaggttcagatgatatccaggccccacgtgggattagcagcctaagcctcagctgagccagggtttcactggcttgtttaaagtggagcacagagcctgaccaagttgtggcatctccaaacctccttctctccgagggatcctccagggtgcctgacccccacgcctgtcggaagtggggccgagtgcccgcaggccggtgaagctgccttctgggagactcagggtctgagtatctggtctgagactctggtcttccctcgccctcctgttctacttcccatgccttctgtaaagtcctgccgtggcctgaagtgtagcccttcctggagtacacagcgagcatgctgtgccggctgtgggccccccacccccgagccgcaaagccccaggccgcctctgcctgctgcctggagacctggcactgccccacaggggcacccacctccagccctcctgcccccgtgactgaggaagcccagtgcttctcacactcctcagactcgctggctgagccaagcagccttggctgaaggaaagagcagcaaactgacccccacgggccgcgacctttccccacccaggcaaggcgacctcaggcacttcagggagcgccagctctggctttcttgtatgaaagtgacagcggatttaaaccacattaacaaaagaaatccctcctctctggactactcaaagcggaagtgctgccacatcctagctgcagcgcttctgggccaaatatcaagacagtgtctcagcgatgatccgcaaaccaaaataaagccgacaggaaacagcccgctggtttaggggagctggaatgcctccggcagcatcaaatgtcatcaacaactgacactcagcccgttcccggaggcctcttcacacgggaagaggccggctgcgaagtgcggctcagtgggggagaaggaccgtggggaccgcgacactgcaggccctggaagcctctccagcctgaaccgcgctgtggtccagcacactcatggcatgaatatggaacagtcactccaggaaacggtcttgctctgggggagggggaggacttccacatcactctcccaagataaaacaaccagggaaaagcagatccctccagataaaccagaagtccagacacagcctcctctccggaaacgcctccgggagcccacttcagaagctgctgaagcccagagaaaaaccgcagcctcgcaggccctggtcgccaccagctcgcccgccacttctcagtggaaagggacgtggtgccgatgggtccggggtctccccgccccgcgggagccctcagccagaacgccccaccagcacacacgcacacatgcacacacacaaacgcgcgcacacacacgcgcccacacacaaatacacacgcgcgcacacatgcatccacacacaaatacgcacccacacatgcacccacaaacgcacgcgcacacacaccgcccacacatggacacacaaacacaagcacacacaaacacgcgcgcacgcaggcacagacgcgcgcgcacagcagcagcagcgcgccggggcctcacgcccctggggagaagcgtgaaggagcctccacattccccggaaaggaagtttctgggcgcagcggagaaagggagatgccgagaccccgacgtcagtggatttgacacctgaagtgcaggcgcccagacagcctcaggcgcgcgcactcctgcaaacacgcggggcacacgctcgggcgcacacgcggacagacgtccctcggcgcagggaccccacctcctccgccgctaccagggaccggggccgctccgggcgcagaggaggcgcagggagccgcgttaccccggagccgactcgacccagcccgaggcccggggaggcggggaggtggggaggggccgcggagccggaccagccgttctccggggagcgcgccgcgcctggagggcgtctccgccggggtccccagcaaggatctgcggaggggaggcgggcgcgggagaggacagggtcgggccggggggtcggacgcgtggctgccggcggacactcaccgatcttgatcttcacgctctggaagacccggagcccctcgtcctccaccgccatgctgcgcgtccgcgcccgccgagcctcgccccaagcgcgcgccgagcccgggcagctcaggccgagcaggaggagcggcggcgccggagccccgagcgcggccgagggtccgcccgcctgcaagaccgccagttggccgagggcgagggcggggaccgggaggctccgcccgcggcccggcccctgctcccaactggcccgggccctgcaggggcggggttggcagggacggcgctggcgggtggcggagacccggggggcgcagggatcggcttcccccgaggcctcggcccccgcccccgccccgcggattggccgctgagcggaagggaccccagcgggctgcctggcggaagagacgaaggaaggtcgccggcgcggcccgggcccgctgagcgaggctgagcgattgactcgcggacgaactttgccaagagaagttcacgtacaacgatctggcaggggaggaatcccgcgcccagccccagctcctgagatgcgatccgaaggcacctgctgcagacgcacgaggggggcggggacacatacacgcacacacagccccccaccccagacctccggcatgggcaggtcccccccccaagtccccctgcagaccccagcatgggcaggtctccccccccccagtccccctgcagaccccggcatgggcaggtctcccccccccagtccccctgcagaccccggcatgggcaggtctccccccccagtccccctgcagaccccggcatgggcaggtcccccccagtccccctgcagaccccggcatgggcaggtccccccccagtccccctgcagaccccggcacgggcaggtccccccccagtccccctgcagaccccggcaccggcaggtctcccccacccagtccccctgcagaccccagcatgagcaggtccccccccagtccccctgcagaccccagcatgagcaggtcccccccccaagtccccctgcagaccccagcatgggcaggtccccccccagtcccctgcagaccccggcatgggcaggtccccccccagtccccctgcagaccccggcatgggcaggtcccccccccaagtccccctgcagaccccggcatgggcaggtccccccccagttcccctgcagaccccggcatgggcaggtccccccccagtccccctgcagaccccggcatgagcaggtccccccccagtccccctgcagaccccggcatgagcaggtcccccccccaagtccccctgcagaccccggcatgggcaggtccccccccaagtccccttgcagaccccagcatgggcaggtccccccccaagtccccctgcagaccccggcatgggcaggtccccccccagtccccctgcagaccccagcatgggcaggtaccacccttacctccctttcttctgtctcgaggtctcctcctccctgacctcctctctgaggagtatgtttgtgtgtgtgtatgaactgtaggtgtgtatatgaactgagactacactccctcctctatgttgcaaaacttcattgcacccagtgccacacacacaccctacacatatatacacacatacatataccacacatacactacatatacatatacatacacatagacaccacacacagacaccacacacatactacacacgtgtacacacatacatatacacacatatacacacaccctacatacacacaccacatatacacatgaacacatatgttcatatacacacaacacagacagcacacacatatactacccatacacatgcacagacatacacactaaacatacatacacacacctacgtgaacatacacaaacacacacacactgcatggagaggaacaggagcttcatgaagatagaggcctatttttttccactgcttaccttcacttcctaaaaagcagttccatgcgttgaaagaatgaatggcctttcttcccctgactgctgggagcctgcagccacaggggcctctctcatcctcagcccttgcaagcctggtgctcactggggcagaacaggaggttaaggcggcacccctggttccaacccagagcctctgcgtctagcgctggccctgggtggcgtctgcagtgggtgctgtggacgccatccacacccctgctttacgacggagactatgcttccgtttggagccactggaagcaagccggctcctgtgtttctccgaggaccagtggagtcctctgtggcagcccagccacaaagctgcttctctgccatccctccaccctcacaggcctgctgataaactcaacgcggatctcgctttggtgtttgtttccaggcgacagctggggtcaggagtgaatctccagactgcagcagtggcagccaggacgggagccccttggaaggaaatgcactggcagcggcaggatctcgggtgctggagagttcgggaaagtcacagatacatggactatggaatcaggtggctcgtgttgagggcaagataatgaaaagatcaccacctgaaacaaaagggtggcacgctaacgggcctcctcagtgccacataagacactcatctcctgtgaccagaggaaaaccaaaacactggatcagggccaggacttaaccgtgtagaaggcagagctccagagaaggccaggtgcttggcctcagaaggtgttgttccaggttcgggtgctcggcctcggaaggtgctgttccaagctctggaccctgactgggaagaagagaggccctgactgggaagaagagaggcttgcgatggggccatctgaatgaatgcactcaaaaatcttgaatcccagattcctctaaatctgctgggcctgaagaggtgtcacatttctgtctgttaaggacaaatgctgtttctgtgcttgaagacactgcagagacctctgcaaggcgacacgcctgccacccacctccagctcagctcctccaggtcagcatcatcaagctggagaagtgctgaggctaaaaactgaggaagagacagtcggccaaggagcttcaggaccaaaatgcatgcaccagcatgagccaggggtaaatgcagaactagatccaaagaacgttggattcaggggaggcagaatgtagagttagatgttagaattcattgacatgggcgcattcagtcatgatacagggtttagcccctgggaggtgctccgtgctgctagggtggcgttttcaactcgtaaagtaaagcaatgtcccacattaagcagctgtctgtcaggattggaaaaggcactcctggggtccaggctcactgcaccggctggtggcccaggcccagacgtcagcagggctggagcagggcttctctggtgctcctgctggcggctgaggtgcacagtcaccctcacctcccggcaaatgagcactcctctcccagtcatgatggagaaaacacgcatctccctgactcactccttaacccagccgcaaacttcactgggttagcctcggtccatttcactcctacatctcgaaactgtggtcgtctttacgataccacaagaacctggggggcggacagtcccagagaaaaagtttgtgctgcacaaatggatgctgggcatgaccagagtgccccacagacggtcgactcagaccccacgtgcatctctccccagtcggtccctaaaacccaccctcagtgcttatccaggcacatcggagcaaggtatctgtatgtggggcccccagccctctgagaggcacaggggctgagcatacatccagggctcccgcaacaaaacacagccccgcagagctgcccaagcaccggccttctcacatttgtgttctaaatgaaggatttggtcattcgttttctaaattagaaagttgtctcttagagctgtgataatatgagctgggaaataaaatactgagagaagaaaggatcagatgatgacccaatagaaaatctctataatttcttctttcaatgaccttggtgttacactttgctctctttggatatactcttctgttcacatatcaacccattgacaagtggacattcattcatttccaaaacagcattattagatcatgtctgaacaatctactttcaaaggatttgaagccacataaatgaccagtacacaacggaataatttttggagggttcaaagtaagaactgaaggaagaacggtggaatcaggtatctgaacctgaaagagcccatcctgccaggtgcatcccaaggggctcactgggcctgaattcaaaatggaggcacgcgaccttttgctcactagaggtcacacgccagctctgcgttcccggaagtgctggaaatttcacagctgtctgttcatgctgctggaatcaaccaaggccagaaaatcccaatttgccctctggaccaaaccaatagactgctaccaggctctaccaaacagaatgaagcaagtctgcctcccttatctgcataaaggccagaatgagatcctgggcaggaattcccttgtggaagacaatcgcatgtttcttctctggaatgcacctttgttttgttccaaaggcagcatctcccagtttgcaaactgcttgctggaataatgtctctttcccctttttttttttttttttgagatggagtttcgctcttgttgcccaggctggagtgcaatggcgcaatctcggcgctcaccacaacctccgcatcccaggttcaagcaattctcctgcctcagcctcccgagtagctgggattacaggcatgcaccactatgcctggctaattttgtatttttagtagagacagggtttctccatgttgaggatggtctcgaactcctgacttcaggtgatccgcccgcctcagcctcccaaagtactggggttacaggcgtgagccaccgcgcccggcctgtctctttccttttaaaagaaatttttttagtggatttgttgacacatgtaaggtgagaacagctgaacgtaaagctacacactgagcttccggatagccaaggtgaaaagggaaatatggaaatatgaatcttacacaagtcacattatctgataaaaggaagcatgtcagactttcaggaaagacagtactttagcccacaaggcaatacaagaaattttttagggaattcttttcaaaaggaatattggacaagttaggggaggatgtttttaatctcaaatgacactcactacagggcctagaacatggtaaatgctcaatgaatgtttgttgaatgaatgtagtaaaaatataacattaaatcataattctcgcataaaatttatgtaggcacttagaagtcaaagaaagtagctttctagtgacctgatgagctgcgaaagaacacatttggagaatctagagagatgaataaatagccaccgaagagtctttctcaaacattagttgagccacacaactgagagaagcagacaggtccactccaagattcctgtggatgccgaggcctggtggtctgtgttgttgatggacaggagacgcaatgctgtgctgggtttatcaactacagtcggaggctcaggtgggccttaccacggagcatcatggtctcgctctcatcttcttgaaatgcagagagagaggaaagaagcagcctagacccccgagtcatgaagcagacagcagtgggtgtagacacggtggcggtgggtgtagacacggtggaggtgggtgtagacacggtggaagtgggtgtagacacggtggtgggtgtagacatggtggaggtgggtgtagacacggtggaggtgggtgtagacacggtggtgggtgtagacacggcggtgggtgtagacacggtggaggtgggtgtagacacggtggtgggtgtagacacggtggtggtgggtgtagacacggtggaggtgggtttagacacggtggtgggtgtagacacggtggtgggtgtagacacggtggaggtgggtgtagacacggtggtgggtgtagacacggtggcggtgggtgtagacacggtggaggtgggtttagacacggtggtgggtgtagacacggtggtgggtgtagacacggtggaggtgggtgtagacacggtggtgggtgtagacacggtggcggtgggtgtagacgcggtggaggtgggtgtagacacggtggtgggtttagacacggtggtgggtgtagacacagtggtggtgggtgtagacacggtggaggtgggtgtagacacggcggtgggtgtagacacggtggcggtgggtgtagacgcggtggaggtgggtgtagacacggtggtgggtttagacacggtggtgggtgtagacacggcggtggtgggtgtagacacggtggtggtgggtgtagacacggcggaggtgggtgtagacacggcggaggtgggtgtagacacggtggtgggtgtagacacagcggtggtgggtgtagacacggcggaggtgggtgtagacacggtggtgggtgtagacacagtggtggtgggtgtagacacggtggaggtgggtttagacacggcggtgggtgtagacacggtggaggtgggtgtagacatggaggtgggtttagacacggtggaggtgggtgtagacacggtggtgggtgtagacacggtggcggtgggtgtagacacggtggcggtgggtgtagacacggtggtgggtgtagacacggtggtggtgggtgtagacacggtggaggtggatgtagacagggtggtgggtgtagacaaggtggagttgggtgtagacacggtggtggtgggtgtagacacggtggtggtgggtgtagacacggtggtgggtgtagacacggtggtggtgggtgtagacacggtggaggtggatgtagacagggtggtgggtgtagacaaggtggagttgggtgtagacacggtggtggtgggtgtagacatggcggaggtgggtgtagacacggtggaggtgggtgtagacacggcggtgggtgtagacacggtggaggtgggtgtagacatggtggtgggtgtagacacggtggtggtgggtgtagacacggtggcggtgggtgtagacacagtggaggtggttttagacatggtggtgggtgtagacacggcggaggtgagtgtagacacggcagaggtgggtgtagacacggtggtgggtgtagacacggcggtgggtgtagacatggtggaggtgggtgtagacagggtggtgggtgtagacacggtggaggtgggtgtagacacggtggaggtgggtgtagacacggtggtgggtgtagacacggtggcggtgggtgtagacacggtggtgggtgtagacacgatggtgggtgtagacacggtggaggtgggtgtagacacggtggtgggtgtagacacagtggcggtgggtgtagacacggcggtgggtgtagacatggtggaggtgggtgtagacagggtggtgggtgtagacacggtggaggtgggtgtagacacggtggtgggtgtagacacggtggcggtgggtgtagacacggtggcggtgagtgtagacacggtggaggtgggtgtagacacggtggtgggtgtagacacggtggaggtgggtgtagacacggtggcagcaccgcacggaacactcaaagcccactttctggctgtgatggccgaggagagctgcctcccctccgagtggcccatcctaggtacccttgagcctcacaagctcagttgccaacctccctgcttcagggaggggtggggcagcgggtgggacaggaaattcaccaggttgtgcagggcagggcaggagagcagagggagacgctcacgcccccgcccccaggcccgcagaagccgtgggtgctgatgaatgcccctcagcccacaaatccctggcaccttgactgtgacaacgatcgcggctgctttcattatacttaggagttgtgaaccaccgcgtcaattacttttatttcttcaaatagtttcctgtgaagctaactcatctccccagattgtctcccaatttcttcgtctgtaaaatggggctggcagcagtgcccgcccgcaggcctgtgccgggaccaagctgcgtgtgctgtgtgtcctgtgtctggcagataagaaacagtcggctagaggtagcttttctcgtggttatttttcccgagagcactggcaggcatttttcctctctgccatcctcccagcactgcacactgtgtcgggcccctggtggatttgcagatctaactcttgtacgtacataaaccacaccaggaccacagaagagaagccgaagtgtgggtgctgtccccagggagcccccgcagtctgcccaggctcagcctcctcccacccacaaggaaggctgtggattaggagagtgaggaaaatgcccttcaaaatacatgatgcataaaaaacacaaacgttcaccgcagatttatttgtaatggcagaaaactggaggcaaccttcaagctgtccttcagcaggtaaagagtgaactgcgtgaaaagcagcaagcgagcgggtgcacagtgttgcaggtgagcctcaggggaactgggctgagtgaagggagacagtctcaagctgacaaagtcacagcaacggaaagcagagcagcgggtgtcagcggtcaggggtcagggaggggcaggaggtggctgtggctggaaaaggagcaggagagatgctcgtgggatggaaatgtccggcatctgcacagagatctgcatacagggcacaactgcccagctctagacacactcacacacacactcacacacacacacacacgggacacaactgcccagctcgtccctcacacacacatgcacacacactccctcacacacacacatgggacacaactgcccaaaactagacacactcacatgtgcacactccctcacacacacacgcacacactacctcacatgtaagcacacatgcacacatgctcacacacactccctcattcacacacacactccctcacatgcacacaccctccctcactcacacacgctagcgcacacatgcacacacacactcactcatacgcgcgcacacacactccctcaatgacacgtgcacacacatgcgcacatacatactccctccctcacacacaaccttacacacaaattccctcacatgcactcacacacgcacacacactccctcacacatacacatacaaactcacatgcacacaccctccctccctcacagacacacatgcacacatgctcacacatgtcctcacatgcccacaccctccttcattcgcacacacacaccctccctcactcacacatgcaagcacacacgtgcacatgctcacacacatcctcacacacttcctcacacaccctcacccacatgcactcacacacatgcacacacactccctcactcatgcacacatacacaagcatactcacgctcatacatgctcacacaccctcccctccctcacacccacatgcacacactcgcacatgcacatatggtcacacagtccctcacacacacactcccagtccctcacacacacaagcacacacacagacatgcacacacattcatgcacttcctccttcacacacattcatgctcctcacacaaatacacccacatgcacacatgcacacagacacactggtacacacacacggacacccacatgcacacacacacaagcatacccacatgcacacatacagacactgacacacacatgcgcacccacatgcacacatacacatagacacactgatactctcacacacccacatgcacacagacacacacacatgcacacccacatatacacagacgcactgacagactcacacagactcacccatacacatacactgacacacacacccccatgctcacacacacactgacacacacgctcacacccagtgtatgtgcagctggtgccatccgccctcagggcacttgatcccatcggtgaccactccttgctttgcaagatgctgctgttgggggaactgggcaaaggggctgctgttgggggaactgggcaaagggaacaggcactctccgtgttattccttacgactgtgtgtgaatctgcaattatctcaaaagagaaccgtttaaagcaagaggactatgtgggagtggacaccagctccctggccctgtcctgctcttgcggcagcccccacctgcccgaggcctccgctgtgggaactggaacctccctcacaggaagggcgtgacctcgtgtttaccagccctgccctgagcgcagagcccttcgtggaaattggtgccttgttgtcatgagaggaaggttgaggccaggagaaacctcaagttcttgtgggcatggtgctgcctcgcggtttgactgcaggaggccttacggcggctccgagatgggtggcttggcctggagcaggacgagccagggcgagggcagctgctgggcgccgtgaccctggctcctgctgcaggctttcctctgggccccctgttccagaaccttctccctctcaggccacctgtgtctgtgcccctcaggaagcaagcaggctttctgcagaccaggctctctccaccctccaggaggcgtggctgtcagggcagctggctggcgccccactgctctccaagccaaccagcaccaggtgtgaaaggagtcaaatgtgtcccaacgtataaacaatgtttatcccgactagacaggccacatcctgatgttttacattctgttctagcttcctagactaaccttgtgtactcagcttctaaatgagtgtcgggcccctcaagtagatgccgtgagcagctgctgtgtgcacgtatgtgtgtgcttgtatgtgtgaacgacagtgtgtgagtgtaagtgagggagtgtgtgtgtgtgaggacgtgtgagagcatgtgcgcatgtgccgaaggtgccagctcaggacaaccaagcattacgtgttcaggaattttgcaagctggttgttaaacagagccattactaaaaattcaattcgatgggcttatagagtttataaaattgcacgaacccatgctctggggtcgctgacatctgttctatggaggaaatacagtcacgcaccacatgacaatgttttgatatggaggaaatacagccacgcaccatataacaatgttttgatatggaggaaatacagccacgcaccatataacaatgttttgatatggaggaaatacagccacgcaccatataacaatgttttggtcaagcagggtggtcccacaggattgtagcaccagattcttactgtcctctcccgggttagttgtgtttggacgcacatacaccactgtgtggcagtcgcctgtggcattcggtacaggagcctgcacacaggtctgtggcggaggagcgctggctgtaccttgcagcccaggcctacagggggcccggccatccaggcgtgtgtaagtcactgtgaggcccgcacagagaaatcgcccagccatgtatttctcagagtgcatccctgtcacaaagccacggtgagtgtgaacgcagggagcgctgcctgtacctcctcccacctgggagtgtctcatgccctcccccaaccccgttttttcctgagtcatttgttaaaccttggcctcgcttgtgactggcagtttgaaatgccctattcaagtcaactcccctccctggcccacgccaccttcgtgtttcctgtgaagaggctgaagggaggccatgggggcccaacgtgtgaccagtgggtactcagctgggagtggtgcacattccaactcagggtccagagctgtcaccccacaaggtcctgcctctcgactcatgcccaccccagaggtaaggaccgtctgcccacagcctgggcttccaggcgctgcagctgggaactgtcaccccacctggaatggtcccctgagatgtggctctgtcaagggctggggacaggttctggctccgggcacgtggactctcgcccacccaggtccaggacccaaggcacagaggctgggctgattcctgggggcctcgctgtgcccttcctgcacagcccctgggggatttgcagggtgtggggtctttgtggggccttgtccttcagagcttcctatttgcccctttcaaattggttgaagaaaccttggggagtcaggagagagccgagaatcaggactgagtgagaacagcgagctgccctccaaggccgcctctgactggggaggcttccgcgtggctgtgcagtcactgggctgatgaggctttccgcccttacaacacaggttcaactacaacacctcaaactcaaccccaacagctatgaaagcagcatcggggaattggaacgaaatcactcccgatcccacctctgctacatccgagccatgtctgttcctgcattcatttcctgcaattttactccccagcattcgtgttttcatgtggttctaactaaggccctagaggctacagccccacgccgtccttgcagaagctgtagctcatctccttcgctattttaattgaatgggcaccaagcgtttgccctggaccacctgtgaaaggcaccgagggagaagccatgggctcaagaccccccagccagggctcgccttaggaccctttacatatttgaagggaggccaggaaggtgcagccacagtttcattctcttatcactctgcctgcatttttcaggtttcaataagagcagatataattagaggggctctgttcctcctggagaaagaacactgcaaattacagggtatctctaatgagccatggaccggaagacagcatcactgacccctcatcatctcaggctctcctcttgccactcccaccatgactggctggatgaccaagcaggggcctgagtgttcagctacaaagacaagcagctccatgcagccttcagagaggaagagaggcaggtggctagagagccccctgtgacagatgggctggtccgggcaggaggaaggagggcaggggctggagagtccctggggaccaatggggcttcttggcctaaatgccacgggtgggagctggggcagcaggggtttgtgaggcactcacctggattatctgtcattgttgtagctcatacagtccaaggacctcagactataaatgtgtggtggtgaattaactacctgttgtgatgttatcctggtcctgtgaagatttacaaggagccatgtcacttctctgccaaaaccctggactgtcctcctgtcccccttggcacaaatcacaaagcgccatcgtgcacacaggagcccgggggctcaggcgtcacccagcagctccaggcctcctggctccaaccctctgccttcttgctttcccttcagcagaacgggtctctcccttcccggggcctttgcacattccccctgtaggaatgctctgtcttgctctctgcaggaattccctctgcagcaatgctctgtccccagggatctgtgtgttgcttctctctgaggacacctgcgagcgagatttcctcgactacacaacgtcaaataactggcccttacctgcatctgccctgctttattttcctgagtaacacgcacgtaacacgcgtcaccacctggcctgctcactgatgtgactgctcattgaccctcccagactcagtggggtgaagatatctcattcctaattgcatctcacttagcagtaataaacagaacacgaatctgcattcaacggtcgatgcttccacagtgtttcctccaatactcgagaatctgctccacaggtaaacggacttctccaactggtgatagaaatggtggtgcccgtggtggtgggaacccacacccaccctcagactccaactcgcgcatctccgcaggcccaacagcccccgctccagtggcgcagagacccccgaaggccggcacctggacgttccccttgagctattcacttaagaagaaaaaacagtccagtctccatagggcactcttctcatccattctgagaattgaaaatcaggctttttgtttgttttgtttttaacctcaaacagcactgtttctaaaccacggggagtgaatccaaatctgaagacagaatatggactgaacttcggggctccctgggctgctggctgtcagctcacctgtgcccacctaccccgtgcccacctgctttacttaccatcctggaaagacttctcagtctcagccatggcccatggcagcccaggcagcccttgccttccgctctctgcgagggagcccctggagggcggcagtggaagagacgctctgaagcctcaacagctccagagaccagtgggcagcctttccattcctgtgtgccggcctgacatccccccgcgtgaactcccttgcacacacacgaacacacacacacagagattacccacacgcccattcaaacagcaacttaataacaaggaactgaaaaaaagaaaggctattagacccaaatgagaatcacaaggtggatcccaatgagaactgtctgcagcatcacactcaccgctgtgtctgagaacaggattttccatttcggcagtggatctaaacctgatgcccaggacctgttttaagcagtgaatcaaagatcacagaagttaaagtttggcaagttttcgacgtcaaggagatggaaagcctaaaatcagtttctgaaccactaaattagagggaacagccttgctcgcgaattttccagaattccacaaacaattaagaagacccagggtaggaagcacatacaatttgttttctttgatggttaagttggtttaaggcacagagttgagaagacaggcaagaagaagcaactgttcaagccccaaggagaatcctgaaccgacccagcccccaaggagaatccagaaccgacccagcccccgaggagaacccagaaccgacccagcccccgaggagaacccagaaccgacccagcccccgaggagatcccagaaccgacccagcccccgaggagaacccagaaccgacccagcccccgaggagatcccagaaccgacccagcccccaatgagatcccacaaccgacccagcccccgaggagatcccagaaccgacccagcccccgaggagaccccagaaccgacccagcccccgaggagaccccagaaccgacccagcccccgaggagatcccagaaccgacccagcccccgaggagatcccacaaccgacccagcccccgaggagaccccagaaccgacccagcccccgaggagatcccagaaccgacccagcccccgaggagatcccacaaccgacccagcccccgaggagatcccacaaccgacccagcccccgaggagaccccagaaccgacccagcccccgaggagatcccacaaccgacccagcccccgaggagaccccagaaccgacccagcccccgaggagatcccacaaccgacccagcccccacggagaacccagaaccgacccagcacctgggcaacattctgcccccggcctcctccacttgctgggcatgcatcaccgtcatctgcagccactttccccaatgccagaatcagaaattttcaaaatggttgaatagtatttggttattttttgataggatataatgcttttgttccttctttgacttcacgttttctttgttctctaagctaaatgccagcatttaaactgtataccgagacacacaattgtgtgaatattagcttgaggctctcttaagacagactcagatatccaaaggctttgaactcacagaattttgtaaaactcgaagcacattcgcactgccctttggaacctgccttgtctacagagctaataggcaagacccagctcacccagggggctcggggatccccagccctgcgtgactttgcaacaccagctgagatgcctggttcccagttaagttactaggatgagttacagcactatttattcaaaactctgagaggcccgtgttactgctaattccaattttaacttttcttccagaatggcaggaagcgatgagggcagctgaggtttccagagctcgtgtgtagcaggcgccacggctagtgcatcatgtgaaattatgttgcttttctcaactgtgaggtggggactcaacatggtttccatcgcagcccatacaggctgctgtggttgaccaagcttcctttgctggcagggctgggtgtgttctgctggctgcagctcaccaccatgctcagaatggctcataatcatttgttgtgtactgttttttccaaagacacgtctctgagactacgtcagctgcacctggacatggtcacacgtcaacatcatacagagtggtttctcaggtagcagaaagtgacaaatgagacacggttattcttgtaaggcaactgtgaaataacagggtatcacacaaatttaggtggccattgtcttcgtctcaaattttctccttaagaaattaaaaacaggagagaaaaacaagttttcgattaaaaaacaaggagatcctgggatctccgtgggggctgggtggatcctggattctcctcggaggctgggtcggttctgggatctccgtgggggctgagtcggttctgggatctcctcgggggctgggtcggttctgggatctcctcgggggctgggtcggttctgggatctccacgggggctgggtcggttgtgggttctcctcgggggctgggtcggttctgggatctcctcgggggctgggtcggttctgggttctcctcgggggctgggtcggttctgggttctccttggggcttgaacagttgcttcttcttacctgtcttctcaactctgtgccttaaaccaacttaaccatcaaagaaaacaaattgtatgtgcttcctaccctgggtcttcttaattgtttgtggaattctggaaaattcacgagcaaggctgttccctctaatttagtggttcagaaactgattttaggctttccatctccttgacgtcgaaaacttgccaaactttaacttctgtgatctttgattcactgcttaaaacaggtcctgggcatcaggtttagatccactgccgaaatggaaaatcctgttctcagacacagcggtgagtgtgatgctgcagacagttctcattgggatcacattttcttctctgttcaggtggaggcatttcatacattttttaccaggaccagacaaccttggcaaatcatctagaaagcacagtaaatgtgaaaatgtgattaaataaacaggtgttggatttcagaatactgttttattttttttcctcaaaagacatctgcttaccaatctcagtgttactggggctgaaggccatgctctttccaatgatgggactacactcaagtgctaatttattacaattacaagtttcccttcaccactgctgatggcataatttgaccacaagtgttttgcaaatatatcacacctggtattccaggacccacttcaaccactggcttgactcagaattttccaacagggacaattagcatgtgccacctgctggaaacactagccacacctgaagtgaaaggagaatcctggaaagtcttcccctggagctaccagactccccactctcgagtctggtggacacggcactgtcaggacccctcccctcggcagagagtggtggtcggctgcaggtctgcccaccgtctgacgggattccagctctgccccagtgcttggcacctgggtgcttctgttaaacccagtccctcccagacccttcccagattaaacctggacccaggaccccgcccttagctgcattatcactgcccagcagacctgaccctaaccctaaccgccagagatcctgttaagcaggtctatggtggggcccagaattcacacttcatccacttcccaagtgatgctttactgttggtcccagaatagggtgatagcccctcagtctgccaggggcaaaggagggttcctgtgacctgggactttcagcgttgaagctggagcagccctagggcaaagtgggacggtcacctcacctggggacctcacctggggacctcacctggggatcacacctggggacctcacctggggaccacactttgagaaccacttacctggatcctttattaatcctacggtggagaaaaactgctgacattaattgtgctgaactttgtatttttattgcagacttcttccttcgagatgtatgtgcacaagagaagataacaaatgagtccccaacacctaatctggaatttttatattaagttttctctctcttagagaagaattttcaaagagtagtcattcaaaaagcaaaacacacaaacaaaaccctaaaactttgagagaccattttatgcctggagccaaagatgaattttataggctttgcttctttaggtcttggctccaaattctacacagtgctgtgttcctttccaccatcaacatacagaaccaattccccttctggattgtatgcactgaagaactttagctttatttattaactttttaaagatctctcaattggttacataacaaaccaccaccagcctagtggtgtaaaggaagcagcatcatttcccgaaattctgagggttggctggaaggttctcggggctgagactcctgggctgggctggggtggaagagggcctcactcacacgtgcaaggccttggcagagacatggcctccgaggcacctgaggtctctgtcattcactccctcattctcaggaggccaactcggcctgcccacttggcagcagaaggttcccaccgcaacagcggggacgtccaatgcctttcaagcacttcccaagtttctgctggtgtcagggctgcttttgtccccttggtcaagctgcaccgtgtgtccaggcccagcggtcacaggggaagggccatgcaggctcggtgtatggaggcaagtctgggcaccatcacaaactcaccatttcaacaaaacactcattgtttctgaactatctttaaaaacaacttttaagaaataagaaaagctatttccagagcactcaccagtgccacgtgcacacggatcatctaattctaggggggcaactgcacggtttgcccccgaccgtccagtgttagtgtccaaggaagcccctcagttccgaggtgaaccaacagaacagatcaccctgtgaggtatgaagtgttgtcctctgcattcgacagatgaggaggttacagctgcgagactgtaggcggttgcccgggcgctcttccaagtaggtagcagggccgagtgaatgagcctaggcaccgcccggtattgctgcaacagccaggcggcgctttgacttctgggtcagtgtcactgcctacctgaatcactcacttcctgtaaaatacttgattccaaattactttggtctgtattgaaaaataaaattcaagtttacctttaaagacaaagatttgccatatttaaggatattttagagaacgtgctactgactctgaagaagaggcataaaaccgccttgaggaacggcatcgtctgtgctgaagcaggcagcgcccagctgacgactgtcaatgcagccctagcaaacacggccacgctgccctccatccagggtcctgtccagtgctgtgctaagcacttcacgtggtgacagctagctgcacaccaggcacggtcaggtgcttagcgtttattaagtcgttcaattcttctgtaaccccatgaaatggatgctattgctagagctgttttctacagagaatttaaggattttgcctaaggagatgtcaccagcaagtagcagaccatggtttgaacctgtcccccagtcccaagtctacacataactgttgtcccacgggtgataggtgtgacagtcctaggctccagctctttccccggcgccacagtgcctgctgtgcttggagacaccaccctcacctgactgggagagctccactcaaggacccgcacaaaaataatcccagcttccgtggtttcctcacaccattccccgctcacagtttacctccctaggaacccaacactgttttcctgtagctcatcacttcacaaatgtattgccttttgttaaaatcgtgaataagcctctggtctgactgcctctgcggggtttttgtctcatttcgtgaagccgccacatgcatatgaagtaacgctttttctcctgttaatctacttttgccagttcaatttgcaggactccagtcactaaaaaacataagtgagtgaaggaaaagtttttttcctcaccacctgtttgttggaaagcaagtaatggcccacctggtattcttttggtcaagacacaacggggaaatggggctccggtcaggcccctcaggttgggcctaattggagcagaatcggaggggcctgggcttcttgctgccagtggcaaatgtccagtcaggaagtcacacgggcagcagcaatgccggcaagggacgcttgtagcaggaacggggcagcctcccttactcaaacaagacgcggactgcctgaggccggcagctcagagaacaaaaggcaagtgtgagggggacggggtcagtactcagaaagctccatgtgccttcctgctgaaagcaacattgaaagcacaacatgtgcatttggttaaaaacgctgagggcttgtgctgggaggcggcagtggtggcctcaaccatctccccgtccgcccgcatggcaaccacgacgactatttcctctggtcaggcatttccaacctcctcctgttattacaacactctctactcactaattttagatagagtctgtgccagacttccgactacgatagtgagaattcagccaacttgctctgaagaaatcatacagggcctaaactttctgagtccgtatgagtctaaaaatatctttattattcccacacacttaatttagggtccaggataaaagcagattttgccgagagcctagaggcatcactccaccatctccaccactacatccctccatcatctccatcactacatcactccaccatctccatcactgcatcactccaccatctccatcatctccatctctccatcactccatcactccatcatctccctcatctccatcactccatactccatcatcaccatctccatcattccatcatctccatcatctccatcattccatcacaccatcatctccatcatctccatagtctccatcactccatcactccatactccatcatctccatcactccatcatctccatcatctccatagtctccatcactccatcactccatgctccatcatctccatcactgcatcatctcctcattccatcatctccatcatctccatcactccatcatctccatgcctgttgacattttctcaggacctgcctgcacgcctcgacctctgccttggaaggtctgggctgctgtgttttctgcttgtttcttgcacacaacgtaaagttgggtttcactttgcgaatgatcccacgagtctttttgttgaagaggtgagtcgaatttatttacttatgtagactgagaggaaggatgcagtggcccttggttttgtcatatttcatgttatagtttctaaccaatcctcttttaaaaatttcactaagcattctgtgttccactgtgggtgtgtcttgatttggaaggttgatgtttttgttccaggagatacgtttgctcagttttccttccccttgtggccacacttctctgctgctctcatcgtttcatttgtgcctttcccgttttttgtctgttggtttgtctgtgccatggtgtgatcctagctcactgtcacctccaactcccaagctcaagcacctcccgcctaggccttcaaagtgctaggattgcaagcgccgccccacgctcagcccctttcccttgttaaaaagtgccttactctcaagaggctgaggcaggagaatcgcttgaacccgggaggtgaaagttgcagtgagccgagccgagatcgcgccattgcattccagcctgggtgacagagcaagactctgtctcaaaaaaaaaaagccttactctgtctgtgtctagaccctgtggggcttctctggttaagggggcctgtcctccttagatgagctgtcccaggaggctgctacttcctgcagctgctgaggctcaccctcctctttccaccactgaggcccaaggctccagttgctctgaggagtgtggaggcccgtgaggtgtgggggtgcggagtggccgtggaaggtgtgtaggggattgcagttggggttgggtgctggatgtgcaggtagagtataagggtagggggttaaggtgtggggcatgggggagattggggaggttgggaacatggggcaaagtggtgggggatgggggatgcaggggtggggatgggggatgcaggggtggggtgtggagttatggtgagtggggggctgtagtggggcgttgggggtggagggggctgtgagggtgtggggtgtgggtcatgagacatgggacagtgggggctaacggggtgggtggggtgtggggtgtgggatgcagagtgtgggagctcagggagttagaaggtcgagttagagggtgtaggtgtgggggcatgatggtggggcctgggggagggggagggtgcgcaggtgcaaggtgtgagggtggaaggctgggagaccggtagtgtgtgcgactgtggggtgtggaagtgggggactcaggggaggagtggggtgtggaggtgtggggcacggggtggggggttagggaagggtggaatgtagggggagtttgatgtaagggtgggggctatgaggaggggtggggtgtgagggtgagggtgggggctttgggcagggtagaggtgtggggcatggggtggaaggctgtgggagcagtggggtatggggtgcagggcatgagggtgaggggctaaggggaaagtggaggtgtggggcatggggatggaagattagggccagtggtggggtgtaggggtgtagggtgttacctggagggggaaggtgtgggatgcacggtgtgagggtggaggggtggggagggtgggtgctgggcatacgggtggacagtggggaggggtgggggccaggcatgaggatgaaggggtggggaggggtgggtgctgagtgtgggggtggagggtggggaggggtgggggccgggcatgagggtggagaagtggggaggagtgggtgctgggcgtggaggtggaggggtggggaggggtggggtgcagagggttgggagggaggggtgagggaaggggaggtgctgggcgtgggggagggggggtgggtgccaagcctgggggtggagggtgggtgtggtgggtgcggggcctggtggtggagggagggtgggttgggtgctgggcatggggtggaggatgggtggggtgggtgctgggtgtgggggtggaggggtggggaagggtgggtgccaggcgtgggggtggaggggtggggaagggtgggtgctgggcgtgggggtggagggatgggtggggtgggtgctgggcctgggtttggaggggtgggtggggtggatgccagatgtgagggtgggtgccgggcctgggggtggaggggtgggtggggtgggtgaggtggatgccggatgtgagggtagaggggtgggtgctgggtgtgggggtggaggggtggggaagggtgggtgctgggcgtggggggggaggggtggggaagggtgggtgctgggcgtggatggggtgggtgctgggcgtgggggtggaggggtggggaagggtgggtgctgggcgtggggggggaggggtggggaagggtgggtgctggggcgtggggaggggtggggaagggtgggtgctgggcgtggatggggtgggtgctgggcgtggggtgtgcacctcctctgggctccccgaccttcaccctcgcccttcccagtcctggtgtcaaggtaactggaatgtgtttctgtttctctttctccttttgattgtttttctccccagaagaggagaggaagtgtcctttcggtcccctgtcctgggtctccttgcttgcccccacctccccaccagcctctgccctgtccttctgctccggaaagtttcctctgtggaggaagcgtcctgcctcccttctcttctctgaagcctattcgcctggcatttcctcagcgcatggtccaggactttaatctctccttgagaattctccatctgtctttttgaggcatattctggaaacctcactggaccctgaagtccatctctttcgtgggattttcagttcagaaatcatattttaaacatctttcctgctctctgcctgttcttaactagtattctgttcttatgttacctatatgcgtattttcttgaatattctgaggacagtaattagatctttaacttcattttttgttttcccacttagctgttttctctgaggtcagctgtcacctttttttttttttttttgagacggagtttcactcttgttgcccaggctggagtgcccaggctggagtgcaatggtgcggtctcagctcaccgcaacctccgcctcccgggttcaagcgattctcctgcctcagcctcccgagtagctgggattacaggcatgcaccaccatgcccggctaattttgtatttttagtagagacggggtttctccatgttggccaggctggtcgtgaactcccgaactctcaatccacccacctcggcctcccaaagtgctgggattacaggcatgagccaccacgcccagccagctgtcacctttgtggatcctccccctctgtcgctggtttctatggaaagtctggagaagcctgctcacctgtgtctaagaaccagtggctcatttagatgggatactgtgggttttccgtggggtcctccaggtggaaaggtgagctaggggtggaaaggtagctgggggtggaaaggtgagctgggagggaatccacagacggggcgtggctgtgctttatttaggacagatgggtgaggagcaggcagcaggctagcatctctcccttcccccgaaacactgcaatccacactagaataaggcacatatacaccatggaatactgtgcagccatgaaaaaatgatgagtgcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacacggggcctgttgtggggttggggggagggatagcattaggagatatacctaatgtaaatgacgagttaatgggtgcagcacaccaacatggcacatgtatacatatgtaacaaacctgcacgttgtgcacatgtaccctaaaacttaaagtataattaaaaaaaaaaaagattttaccctggggccctagacccaggctgcaagctgtggccacacccaggatgctgactccagggccgtgaataagaatcttctgacgctgcctgggaacctgctggcttcttggcgggatacagacgcaggcacgggttgcagaggtgactactgccaggcacttgttcacaggcaactggaattaccagcccccaccccgttttcagccccacatctatctccctttgacctcccagctcagtgccactctgggatccctcagcaagatgaccctggcctccaccattgatctctgagcatctctggctgggcgccttcaccctgccccaccgcccacacccttgcatccccttccacctttggaaatcattggccattctcatctgccagcacctctattcctgttctctttggggctacacgtttctccttggactttgtttcaatccaactgggcctgaagaggagggaggccctgcattcagggtgcccagcagcaactgccctccacttagcgggagttcaggacaggacagagtgcttagacatctgggggcattccagcacttccaaagaccccgtgcgtggtgttctcaacgtctgtaaaatgtggaggtgaacattagactattgctctcctaagaacttcagtcacgctgagcacagggggtaaattcatccctggtcgcattcttgtgaaaggcattatgtagcagatcatctttttttttctttaatttcattttattttattttaagttctgggatacatgtgcaggacgtgcagccttgttgcataggtaaacgtgtgccatggtgatttgctgcacagatcaacccttcacctagatattaagtccagcatacattatcttatttttcctgatgctctcccgccccccaaccccacgacaggccccggtgtgtgttgttcccctccctgtgtccatgtgttctcattgttcagctctcacttataagtgagaacacgcagtgtttggttttctgttcctgtgttagtttgcagaggataacggcttccagctccatccatgtccctgcaaagacatgatcgcattcctttttatggctgcgtagtattccatggggtatatgtgccacgttttctttgtccagtctatcattgatgggcatttgggttgattccatgtctttgctattgtgaataatgctacaatgaacatacgcatacgtgtatctttataatagaatgatttataatcctttgggtatacacccagtaatgagattgctgagccaaatggtatttctggttccagatctttgaggaatcaccacactgtcttccacaatggttgaactaatttacactcccaccaacagtgtaaaagcatttctatttctctacagcctcaccagcatccgttgtttcttgagtttttaataatctccattctggctggcgtgagatggtttctcattgtggttttgatttgcatttctctaatgatcagcgatgttgagctgtttctcctatgcttgttggccacatgtatgtcttcttttgagaagtgtctgttcatgtcctttgccaactttttaacaacaaggttgttgggtttttttcttataaatttgtttaagttccttgtagattctggatattagacctctgtcagatggagagtttgcaaaaattttctcccattctgtaggttgcctgttcactctgatgacagtttcttttgctgtgcagaagctctttagtttaattaggtcccatttgtcaatttttgcttttgttacaattgcttttggtgatttcatcatgaaatatttgcccgtgactgtgtcctgaatggtattgctgagattttcttctagggtttttatagtttggagttttacatttaagtctttaatccatcttgaattgattttaatataaggtgtaagaaaggggtccagtttcaattttctggatgtggctagccagttttcctggcaccatttattagacaggaaatcctttccccattgcatgttttagtcaagtttgtcaaagatcagatggctgaagatgtgtggtcttagttctgagttctttattctgttccattggtctatgtgtctgtttttgtgccagtgccatgctgttttggttactgcagccttgtctgaggtcaggtaactgaagcatccagcttcgttctttttccttaggattgtcttggctatatcggctcttttttggtcccatatgaattttaaagtagttttttctaattctgtgaagaacgtcaatggtagtttaaagggaattgcattgaatctataaattactgtaggcaatatggccattttcacaacattgattcttcctgttcatgaccatgcagtgtgtttccatttgtttgtgtcctctctgatttccttgaacagtggtttgtagttctccttgaagaggtcattcacttcccttgttagctgtattcctaggtattttattgtcttcgcagcaattgtgaatggaaattcattcatgatttggctctctgcttgtctattattggtgtataggaatgcttgcagtttctgcacattgattttgtatcctgagactttgatgaagttgcttatcagcttaaggagatttggggctgagatgatggggttttctagatataggatcatatcatctgcagagacagtctgacttgctctcttcctatttgaataacctttatttctttctcttgcctgattgccctgggcagaacttccaatactgtgttgaataggagtggtgcgagagggcatccttgtcttgtgccagttttcaagggaacgattccagcttttgcccattcagtatgttattggctgtgggtttgtcataaatggcttttattcttttgaggtatgttccatcaatacctagcttattgagagtttttaacatgaaaggatgttgaattttaccaaaggccttttggtagcaggtcatctttacaaatgttgtatctactcctgactcattttcaaagcaggactcaccgtgaccccccctcatcccgcaattgttccactgcctcgtcattcgtccccagcttgtgagaacgctcacgttggccctccgtgcccctcctgattgtcacccactgggtgaatcagtttcctgagcaaaggttcgcctccaatgaggtcaacgcacatgtggcagggacccagtatggtttgttcggaaacccgtttcatgcggagccagcagaagccacgttaaacgcacgcgttcttccatccctctgctcaccggaagcgagcttcccaaggcgggcacggcgccgcccccccagtcacgcggcttccgcttccggtcgtgccctctcgcctctaactagagaacgcctcgcggtgtgagtgaaactctggcggcctcgctaacacgccaaacctctgtcctcagaatacgaagggcaaagtgtgtcccactcacgcgcaggcttccccgcggcggccacagcggcggggggcgggggtcgtgctcaccgtcgtccagttcaccggcatgttttcaatcagccatcacgagcgaagtgctgcttcgtgtccaccagggaaagcttcagggagcacgttattggcactcaagatgccagccatgggctgcctggaacgacggtttttatcatttatgtgagtcctgggacattttcttccaacagacctaagtatgtatgacaccagcatattacacgaagccgagagggggctgctctgggtgagcgtggaggaacacacgacccctcccacgctcacgtgcccacaacctccaggacagcccagcctgggtgaactgcaacttctttagctcaagggacatctgcttttccccagaggggcccctggtgcagaagcaagttggggagtgtgcagagccgggaagaagcaaagcgagggtatgggtgggagggagtgggaatccttggatttggcagagaacaagtaaattttcggaaatcatagtcagcgtggtctccacaaagatgagagggcaggaactcgattggaagggggccagtgaagctgctgtcaggaagctctcacagggcagtaaacagctcctggcacccggaataggaggaggaagtcgagaacccacagccgccctgcccagcctggctcctcctcacccgcccaggctgctgtgctcctcacgggaggaaaacccgcctgcgtccagctacctccaggaaagcaacaactgcccgtcctcgactaaaggccaaaccttttaacatttttgtccttgaccacggcatcagctgtgctgtctacagaaggaactatattattcccacttaaatagctcggtgtttcgtcaagagagtgcaaacacgagggcttcggtagagggaggagacactggctcaggaaccagagctcacggttcctgctgtctctgccccttgacctcggtgtgaggcggctgcgactgggtctctgctgtgtaaatattgtgcctgagggccattttgacaatgaccgtttctactttaaaaacaaagcagaccaagggagtctctggtccagggataaggtgcctgcagtgcttttccgacacctaaatctctgctttgtcctgagagaaacaagcgtcacgaacttagctcactgttggtgaagtgacggccgccagggaagagtgcagggatctcaggagagacgctcgggtcctttttcaaaaccagtgtgatgcacgatatgtgactactcgccagagtctcgggagagtgtgacgagcgatgggtggctactcaccagagcgactggatttctgtctgaggctactgcatatgctgggtcttagcaagcaacggccatgcggccatcaaggcacaacagagagctcttcttctaggaagttcgaggcattaaaaatttcctccactgggagcatgagcataaatatcttccatattgttcccagtttttctgaaggcgaaagaaaataaagaaggccagtcaattagaaatctgaatttttctattaaagaaggcaggggttagccgggcacagtggctcacgcctgtaatcccagcactttggaaggccaaggtgggtggatcacttgaggtcaggagtttgagactatcctggctaacatggtgaaaccctgtctctactaaaaatacaaaaattagctgggcgtgatggcaggcgcctgtaatcccagctactcgggaggctgaggcaggagaactgcttgaacccgggaggcagaggttgcagtgagtggagatcgcgccactgcactccagcctgggtgacagagtgagaccccatctcaaaataaataaataaataaaaataaagaaggcgggggttcctgtctctatttttccaggagaacaaatattaccaatgtacaaaactagggggagacaggagtgactttacctcactgccaacgcctccaacacagtctccattcacaggtcaagacagaaaaggagtttcctggaagactgcagagtctgccacagacccagggcagctggacttcctgcagatctaaagccagggctggaaaagccacccagagcccatcaggcctcctggacctgcttcttggtccctcttctcaaagtcctctcccctgaaggctatttcccctgcctctccctcatctcatctcccacagtctcctagtgtctctgccagccacatgccgagagaaccagctgcgccccaacacttccagtctctagagagatcatttccgtgatccattcagctgggcccaggccgagggcaggggcaggagtggtcatgtgttaagaacagggcagactgggtgggttgtgggtcgtggggagctgggcagacaccctgcagggcgtccacaacacccgttcctaatgggaatgtaactgaaagatagcggagatgagcttttcccagagtttgggaaaagcataaggagtgaggaaggctgcaccctcaccagccttccccagtgacgacggagctgtacaccctcaagcagatgctgtcaactcctgggagacacagtttctttactgaaaacacgagcctagactaggactggacggttcttgctttgtttttttgtttctttctacaccattcacattccattggtagaagtgctccttccatacccggcagggggaccgagggggccatgtggcactgagcgggctgccgggaccaagggggctcatcagccccttaggtggggtgggggcatgcaccgtttgagcaccaccgccggactctgcacccagcgagggaccctctcctccctgcctctgaccaccactgtgaattacaactccaagcagtgcttccctggccacgcaggaggagttacaggggttgaggaagcgtggcctaaggagaggcagatgggggaaggatgtgtgctctgccgtcttcaatactgaggggcctcgtgtgcagaaggacgtcgtttcttcagtgtgacttcaatgggcagaattagaataaaaaggtaaagtttattatggaagaaggtaaatctcagctcatctcaaccactttctctaagttagagttgagttgacccccgattcaaaggtgctgcttcgggaaggcacagtgcatgtccctgtgctgtctatggcaagaacttgattcaaggaggatggaagccagaggcacccagctcctccaccattcagcccgaggcccaggagcaccgtcctttcccagtgcttctacctctggtcttattcgcctcttgtgacacagctatgatgtgacgtcctgcattttactgatgtggacgctgaggtccaaagacaagcagcctcccagggacacacggagctggagtcccccgagtctctgggctcctggctggggttcctgccgcctgccctgctgccagcacaagcgtcctcgtcgctgtctggggtgcacgctggggcatgtgcttagttcgtacttcccattcatggaagagatgatgagccccagtaagaaaataatttgaaaataatttactggtgggtgcacgctaagttcccacaaggaaacagacatgcagttcggtgctgagagctcagtgaccatcctggggacaagtggtgtgggagcgatcacactgcacaccaggccacctgccccccagcttcccagctcaccctcacgcctgtcttcctcaccccagcccacccacacggccccttcaccatgcacagaccctggcaaagcgcagagtgccttcactcgaactttctcaggactacagcctgcccggccagtcggcccttcctagcctgcttggaaggtgaagaaagtggtctccatgtcacccgcataaaaggcgacgactatctgctcggatgtcataggctgaccttcccaaaacaatctccctcagaaccaacctaggtgctcagtgtgaactctcacccattagattgacagagtggttctcgactggggttgatttttgctgccatctctccccaggggacagcaacgcctgtaaactctttgagctgtcacactggatgtgaggcacacctacagccatagaatcctagaagccaggggtgccacccagatcccacagcgcaaaggacatctccccacagcacagaattgtttgacccaaaatatcgcttttcatcagtggccttctaaactctgcctcttaggtgataggctgctcccacctaggactgcgtgttaaaatgtgaaaacgggcggaagcttggcagcatgcacagctttaatcagggattccgtctggaatacctgctgggagtcactctctccaggttagtggccatcgtgataagcgattctgggggaaggaggaggaggagaagtgggaggaggtcttggtgcagcaggaggcatttaagatgggatggactgaggagccgcagtcgctggattggacccaagccaccaagctggaccacaaatgaagccctggatccacacctcctcctggtcacagtgacagttcccacctaggacatctgaccttctaaaggccaaggcagttctttactaagcagacgaatactactttcttctcaatttcattttccttctcagttggaggagagggtgcagtttgtatttcattgaattttctccttttcttgaagggaaggatatgttgccaaaaatactcatgaactgcttccttgtttttgtgatggagaaaatgattatttattttacaattgcatctgcattaagatggcaacaaggggccgtgggctgaggggttagggtcctgtcccctctctgtgcgctggagagcttactgggcatcttgcaggtctcctggacagaggccccagggctcagaagcacacacacacatcctgtctagtttgtgggaccctgcagagcccaggctccaagggctgctgagatggctcagcacacgcgggtctgagcatcaaaggcttctgtgccttgcgccgcccccgaccccgcctgcagcctcagctgccctctgccttcctggcaggcactgcccatgggttctccgccagggcctggctgctttccagcctgtgccccagccccggagggaccgtcccctgcagatgacatgagctttgcctaaggccagacttgaggaccagtaactagggacaaaaaaatagctgctcagaatagcacaaaagctgttgttgttcagttctgaaagtcttactgcatcctatggccagatgaaaaaggaaccgaggcggagaccccgggcaggacgtggtgcttttgcagacagtaagggaaccaggcagcctccagctctggtgtgctctctgcccgcatgggtctgcagcccctgctccctctcctcaccacgggctgcgagctcttggcatggctgccccagcatcggggttgcccaggtttcctggcaaaaaccaactgaacgttcagatcacctccctattcagctggcttggagcagagagcaggaatggtgcctggcctccttcccaggcagccttcctgggaagcctccagggccctggaagttgagtgtccggtgccttcttgtctgtggtctcctctctgtgattccctgggacatccaaggcctgaaacaatgtggggctgaggaagcaaggacgccttcgccagccaggcggtcagacaccatgaggtcccagggaggggctgttcagacaccgacggccgagggactcttgtttgctttataagagaatccatcttgtgagcagggtgggcttgcaggcagtggttttgtgtttttttgaatttctaagctcagtaggtatgagatggtgtcagtggagaaggggccggctgtaaagatgtgatcaaggcctagtttgcacatcaaatagattttctttaattaaccacacaaaatgataaaaactttaaaatggctttcttcccacctgtgaaaagaaaaacttcagctgaattaaatctaaaggagtttaattgagcaatgaaggattcacgaattgggcagcccccagaatcacagcagattcaaagagattccagtgcagtcatgtggcagaagatttatagacaaaaaaaagagaaatgatgtacagaaatcggaagtgaggcacagaacagctggcgactcagcgtttgccttatttgaacacagtttgaacactcagcagggtaagtggctaaagtacggccactgggattggccaaggctcagtgattgttacaggctcagactcctaagttttctatcttgtctacctattaagtcaggttgtagctcatccacaaggactcaaatagagaagtacagagaccttctcaggacatatttactttgctttaacaattcccctcttttggtcattttctcaatttttgagagattaaccaaaactttagtcagcgatgtcactatcaccatagtaaatgtacttatttggtcttgaaacccactggaaaatagtagaacagtgagttttgcaaaggtaagaagaaggactgaacagaaggcacctcctcatactgaacgtcctgtttacaggaggaaaacaaaacctggtctgttctgtcctaggatctgtacgtttccttcaagtctttgattatgtcacatttagcacaagaaactctatttttgtctgattgggtctgttggggcctattgtatgagctcagttcaaaacaatggcctcccatcattttgtttaaaataaattccccctttttggtcaggttctcacttaggtgagagtgtgaccaaaacttagggcattagcgccgctctcagttaccatgattttgggtttctggtctcagcacatccctcataggttatggtgtcctcatggtcacacatttctttcagctctagtcattccaattgaagagagaccatttgacattctaaagatagctgcatgcaaacatttgaaatctttgagagaatacagtgcaccagggagactattattatgactattgggaggataataccaagagtctgcaatatactccttacccagggtccccataaaccaaacctcctaaaatcaaatagatcaaagaatgagcttgataaggagtctactcacttgactaagtcgttttttcattaatccccttcaactgaatctctgtaatacccgatgttttcttcataggccgtaagtgccagcaactgcacagatacttctctgtttagccacttttcagcataacttttataagagaatttaaagtttgttgtgtaaccatagcttttcagtagaatctgctatagagcctatcatgagggatacatttctaatcattgcctcttttactccaaacaatggaaataaggacctaacaagtgatgcccttccagaagagtgaaggcttcctggcaatgttctctttaactcatgatgtgggttaagaagaattaatcaatgttctgtttctgactgattatgaggcaatgtatgtaccattaaagtttctcacctacatcaggccttcatcttttatctatcaaagtataagattgtccatgtataagactggctgcaaaatccttcacaaataaaagtataccccataagtgcacacaacagaccccctttccatttctattgttcacagaggcataagcaaggagaaaatattcaaaactaagagtctcgtgatagaattcttgatccgtgatcttgggaaaagttggtcacatcaaggatgccaactacttctggggagaaacttccctggttagctttaccttaagggttccaattggtgtccagttccaagagtgtggagggacccttctcagtcgtgagatgatgaactcaaggttcaagtttccaaagttttgttgcagtgaggatggcaatggcagtctttctctgacgttctcagaagatcccatctttgtgttctagattgtgaaggggttgactctcctcagtgaaccataaagaagcttccgttacctgatgaaaatacactgtggcacaataacttagtgttataatatcagccctattgcatgggaaggcttttatacaaccagaaaacatgcattgaaaatgacaattgaatgaaattccttaataaatgtttaaatggcccatcaggtaaccaaatttatctgaagctttgattgtcttcccaggaatatggaaccaaacattggttataaaccatttttgcaatttataaatcaccacatcaatatatttaatttggattattttatcttttcatgatgagtcatggaatgcagaactcttaatattaaaagctttaaggactcgggaaggacaaggaagccatcctagttctccatgagtccatgcttaacattggacttatgtcctcttgaataacagttgtttctccaaatgaggtgcatagcactgttaactaatgtgttatcataggtaacttgacttagaccatagatttcattcaaattgtatatctaaacaatttccgtattggctgatttagcatgaaaatctggcaaagtatttcattggtattcagttaatttttgtcccactttgagttagcagtttgataaactggtcagtcctttcattcaagttccaggaactgttatgcggttcaaatgacatgactctgcagttgttagaaacctgtgttcaagagcgcttgtcagcgtcctccccatcctttcatgaacatcctaaaggacaccatgcttttgaagttttcagaaactgcatcagctttaagcaattaactgtggaaatgactttaaatagttatagttaaaaacacaattccagcactttgggagtccgggtcaggtggatcacctgaggtcaggagtttgagaacagcctggccaacatggcaaaactccatctctactaaaaaatccaaaaattagccaggtgtggtggtgggtgcctgtaatcccagctacttgggaggctgagacaggagaatcacttgaacctgggaggcggaggttgcagtgagccgagatcaccccactgcactccagcttgggcaacagagtcagactccacctcaaaaaaaaaaatgaaataaaataaaataaatagttatagttaaaaccactataactaggaaactttaacacttaagctaggaaatttgtttatttctgtggtctacaataacttgacataataaccataattatgattgatagcatatactcaaacatattagaattttagaaattccatacaattttggaacatatattaatataattcaccaaagtataacctgaagattaaacactatttttattttaacaatgcttcccatgcaacttaacatgtcagataatcccgttgacctctcttttggatgtttcaagggccctctgtagcatcccaaagtcggaggtcagaaaagaccattttgaagctgacatacaattttgagaagcctatcaaatatgttaaaggtttaaaacacttgatgttatgaaatggaattccacatgtccccaggccttaaaagtcaaggcagtttatcaccttaaagcatttagcgaacctagtatttgacctgcataattgagaccaaatgtctttatttttgccaataatctttaaaactttttatttcccaaagattattaaaatcatgtgagctaaagggcattagtttttatttttctttaaaaatatttgatcgaagtgcttatttttctttaagccaattaattagagctctttcatataaacattacacacacaacacatttgtaactacacggacagacagacagaagattattacagtagttgtaagttttcttttaccagtttgttagtttcttaattggattactggtatagggtccagtccttggaagaatggggccaggaaggggtctctggtgcccctgtttttcttaaagagtcccaggctcttggagcttgaatatccacttttaatgaagctgactattatctatagcactgtttaataaaagttcttttaagtttcttattacccgactttagccaggcccaacagccaatatttttgtgcttacagaaaggaaaattcaagactgttcatggaggggaagaggatttaaaaatggcaaatgtcacccaaatatcaatcagaaagtactcattccctaagccgggaattgaaccatgaacctggcagccattgtgatagagagactgaggaaaacatttccacgtggttacaagctcaagcccccagggacgtttaagacaagatggagacctcatctacttttattttctttttcttctttcagggacctgaagcaaagtttataactgaccaatttgcatctcgaacagtgggcttatggtgttttaggcatgcattttatcccaaggtaccccttttaatgacagaacaatacagaaagacacacaaagcacaccagattcactacagtttaagaccagcctcagaattctttttcatattaactaaaactttacagaggagataaacagtgatttttactattcatttaaccagtttgcacagagaaaaagaggccaggatttctctgactcacgaggcatccttagcattttgtcggcatgctaggcttctgggttccctttccccgagggccccactgacccggcttgctgcaccaaagccaatgcagccaagccacagcacaaaggaaaattatctttttctgctctggccagagcaaaatacatgtgacaaaacatagatgttagccactctgctttgcccccaatatcaaactggcaaggctcaaacttgcccccagattggccccatcatctctaaatctttctaaaagcttctgcatattaatatgcatccctagatgagactaatttgtgaaccctcatttttaaatgcacttttgtgcattgttcatttggaacattccactgtaagttacctttagtaagattttgccatttctttaagacttcatggcctcccaggcctaatgtataagccagaaggaactcagttttctagaaactaaggatcccatttttgatagcattagtattaagagaaatacgtaatgtagatgacaggttgatgggtgcagcaaaccaccatggcatgtgtatacctatgtaataaacatgcatgttctgcacatgtaccctacaacttaaagtataattttaaaaaaaaaaggatcctatttttacctaaaatattggctttactctcagattcccttgattaacttagccaattgatatggtttactgtgtccccacccaaatctcaacttgaattatatctcccagaattcccacatgttgtgggagggacccattgggaggtaactgaatcatgggggctggtctttcccatgctattttcatgatagtgaataagtcttgcaggatctgatgggcttatcagcaatttctgattttgcttcctcctcatttttctcctgctgctgccatgtaagaagtgcctttcacctcctgccatgattctgaggcctcccagccatgtggaactgtaagtccaattaaacctctttttgttcccagtttcaggtatgtctttatcagcagcataaaaacagattaatacaccaatgatttttttctacctaagcgcacagggaaaatgaaacaaaggggtggaacacaaaaatccctgtgaatttccaaaagccaaattttataacccctacaatatcagatcccacttctgacaccatctattaaaagaaaaacttgagccaaattaaatctaaaggagtttaattaagcaatgaaggattcacaaattggacagcccccagaatcacagcagatccgaaaagactctagcacggccatgtagtggaagaatatttatagacaaagaaagggaactgacgtacagaaattggaagtgaggtacagacagctggattggttacagctcagggtttgccttatttgaacacagtttggacactcagcagggtgagtggttgaagtacagctgctggaattggccaagactcagctgttgttacaggctcagactcctaaattaggttttcaatcttgtctacctattaagttaggctgcagtttatccacaaggactcataaatctggaagtacagagtccttcttgggccatatttagttgctttaacacacctataacaaattaactttaccaaggtgtcttccagtctcagcttctcacatgctagtaagaggaagtttttccaaggtatcttctgggctcagctccccacttactggtaaaaggagcagttttgtgcatatcttgctgggtttgtctttccagtcatcacaagagtggctgcaccacaccccatcactttctgtgtggagtgggcccagctccagctctgtgcaacagtaaaccagtgacactggaattcatgtgtttatacactcagctttcacatgcttctgcatcaattttttaagactatttccagagtgggattgagacctaagtgaatcgtcccaggaatagggttcttgagaaatgattgcatgagtaaggctgcagttaacaccaccatgactaattaccagcaaattgaactccttctgttctgtgaaagttgctagtaccaaaataggttcactcatatcaaactctaacaaaatggggtggggaggccatgacggggcgccctcatacacaaacacctggacaagcctcatctcaaggcacccctgcacgggcctcaggttcgcccatattaggatgcattgcacgaaaattcctcaagacaggtcggtattacaggtgagcggcctgcacaaggagctaacgccagctctgggacaagctctgctaaccagtgatttttgttacaaagcagcttctgtggagttctctctgtctttaaagatctcccctttgccctggcccctccagtgtgcctgtgatctatcatagcatgcaatcccgtgctattctcacttaaatttatttgttctggagagcctgttcctttgaatttccttttaggtggacagttcaagacccctaacacattaatccacttaatccaaagagctcctcttgtatcagggaaggccacagggacatccctgtcttgttcctgaccttggaattgcattgcttagtttccaaacatgggatttcccagttatcttttgttatgaattcctggctctctgccactgtgaacattatctgtatgatttcagccctttgaaacatgtggacactttttcatggcccagcatacggtcaaattttgcaaatgttgtaaacattctttctgtattgaaaacttttatggtttcctgtactctgcagctatttccgattttgtcttttgtgccttgaagcagagtgagtcttatcatctgtgtctgagccatctgctccaaggttcctgtggtgctagtcgtgtcttctctgcaggattgattcactttgcaagatgtttggtgcactgagacactggaaagttggcagcatcttgagatgtcatcagtccagggccacgttaagataatttcgcgacttgagggttttttaggcactgtgacattaagctaatttcacaactgtgtgaacctgggccgcagggctcttccttgtcttgtcccctgctctgctgtaacctggcagttgttgaaggatgggttatttctgatccacgttttcctgagggtgaagacttcagctcctatgaagactgcccacctgccccatcccccacaaagaccccaccgctggcatcctgagtgccttcaggagaagccctctgagtgctggctcgggggtctgacagatttttttgaccacagcctcaaaattcctgactcctgggtgggctcttcagtatatgcaagatggcctccaggattctggctttgttcagtggaagggtcgacttaagcaggtcacgcagcagttcctggtggtggtgactcccagcttctttagctcagctcttgagtgatttgcactacacagaaggtactggagacacagttaccttttctggaaatcaatgtttgcaagcacatttgccctccaaaggttgaaggttgagtgaatttgaagtggttggagatttgtttgtaaaccactcttctgcagaatgagaacgaagttgctgcttggttttgaagatacggccttttgtgggagggcagaacagaaaaatcaaagcttggatttagagttaaggacacaggaaaagaattatgaatattaaagactgagttaatatgtgtcatatagcaaatactttacatattgcatgcaacatagtaagctgttctatgtaacggcctccacatttcaggatatcacttggtgacatttcaaggcatttctaagaaacaaaacgttaaacttaatattgggccaaaatattgattaaggcagcagctgaacacccaaatataatctggataatcaaagtcaaaaataggcgttggtatttactttctgtagaatataagtagaaactatataataccaaacatccaaacctagcccagtataaaaaataattctccacttaatatagaaatcacaaaatgcagtgtggtgccatggcttggatcccggaacagaggtgcacggtggaagtccgcactgcttctcaacactggaccccagactgcagctcacttccatgcagtgttgcttcatgtgtgcaagcccttgtcagtgtttcattagtcctcaggacagatgccaaggagctgctgcttaactgccttgtctggtctgatcttaagaagcaaaacttgattggagccctgtggtgccctgaaatccagagcatgttgttgggggtgattgattttcctgggtctttagcaacatgtctgatgtttgcagattctgtaccatgggccctgccgtcagtcaagtccaagagcagacgtgagtcgagtggtcagtgggttgcaggtaaccataggccagccgagggtggcagccgtaggtggacagctgggactccttccctgtgggtgacagctgtgggtgacagccgtgggtggacagcatgggtggcagccgtgggtggcagctaggactccttccctgtgggtgacagctgtgggtggacagcatgggtgacagccgtgggtggacagctgtgggtgacagccgtgggtggacagctgtgggtgggcagcatgggtggcagccgtgggtggcaactaggactccttccctgtgggtgacagctgtgagtgacagccgtgggtggcagccgtgggtggcagccgtgggtggcagctaggactccttccctgtgggtgacagctgtgggtggacagcatgggtggcagccgtgggtggacagctgggactccttccatgtggatgacagctgtgggtgacagccatgggtggacagcatgggtgacagctgtgggtggacagctgtgggtgacagccgtgggtggacagcatgggtgacagctgtgggtggacagctgtgggtgacagccgtgggtggacatcatgggtggcagctgtgagtggacagctaggactccttccctgagggtggcagctgtgagtgacagccgtgggtggcagctgggactccttccctgtgggtgacagctgtgggtgacagccgtgggtggacagcatgggtggcagccgtgggtggcagctaggactccttccctgtgggtgacagctgtgggtggacagcatgggtggcagccgtgggtggacagctgggactccttccatgtggatgacagctgtgggtgacagccatgggtggacagcatgggtgacagctgtgggtggacagctaggactccttccctgagggtggcagctgtgagtgacagccttgggtggcagctgggactccttccctgagggtggcagctgtgggtggacagctgtgggtgacagccgtgggtggacagtgtgggtggcagccgtgggtggcagctgggactccttccctgtgggaggcagctgtgagtgacagccgtgggtggacagccgtgggtggcagccgtgggtggcagccgtgggtggcagctgggactccttccctgacctgagctcacttcatttgaccaggagcatcaaaaacagtgtgtgcatccaaaccactgtgaatccccacactgtaaaaacaaaaacttcaaacgtcacatattttgtccactttgccctcaatgcacgctttatccatgtgagtgtgagcagacatagagcacagccctcactcctccatccaccaaccgatggcagcagcaagcacagtcaggcttctcagcacacaggatgaaggaacaagggaagacagccccacggtctgactccgagtcccagctgaggaaccagccaatagcatggacagcactacttcccatcagcatgactgtcaggtatttgtcgagcacctactgaatattaggtatttgttgagcacctactgaatattaggctttttctagtcatttttgaccaatgacaatatcagagtaaaggaaattgattattctaatagaattcctctgaatgtaacatttagattgtataggctaagaaatcataactaagcctcatgtcttaaagtgctggttgtatttctaggtaggaattcttacatctaaattctacagtatatgcaagttatctaaaaattaatacttgtgaacaattatgtattaaaataaatttttcttttcaaaaacccaggcaactttaaaattttcattaaatcaacaattttaacagcctataaaggcttctgccaaatgttgaagatcatcagagctagctgagtacagagcacctcagccacctcaagagtggcaggggaggaaataaagtcatattttggcttcactcacatcttattacttccagatctgattctttctttcagactggcagccactacatcctgctaatattcagagcaaatttctcatgaaatgccctgtatctgctcctcacatatgcaaagctgaacaatgagttcccatccatggattctgcactggagtctcatgtgatgagagctgtagtgtaatgaagaccacagctctgacatgaaaatgatgatgctattttctcattaaccaaatcctctgatgtgtcgtcgccaacattgcgcacgtggcttcaacgaagatgaaacgaccgacagctgtcctagcgccatgttcactccattcgtctcaggaaaaacccatcccaacctgattagagcaatggagagagggtggcttaaaacagctaagcctttgcataactcgtcttcaagtcaatcagaaaaattagggaggatctgctgcctaaccttcaaacaaatattttggaattgtctgaattatataaattattcaagatagaagagaaaggagataaggaaagcagaaagaaaggtactaattaagaaaggaaagaactggagagcgggagaggttgggaggaagggcagaagaaagaggtaggggagaggaagacagcaaggagcaaaggaagggtgggcaggaggaaggttagttggagaatttctcggatcttatgtgtgattatctccttcctctgtagctgaggagtggcatcaaaatggcaacactaaactatccaagatctcctgaaaaaaaaaaacaccccagtggagaagaagatcccactcttcaccattattcttcgcgtgttgtttgagaatcccagactgtcttctggctcccgttcttccccctccttggacgccatgacaactgtcacatgaccctgcaaacacagcgtctccaggtctgcaccaggccccagctgctcctctgtctggaatgagcaagacgattttgttgctgagatgcacggagccccccggctgacctttccctgtgccagtgagtacctgtggcatgcaagggagaaagcctatcaggaccacaggagaaaggtaggaaagtccccaatccagccctgacagctcagcgggcgggcaccaagcagcgcccacgaaatgcctctgctttccctggagtcctggaggtgattttctttttggagacagcatggttgaaatgacatttcctaacaagattcatcatctatgttgccatacaataaaaatctcattaaatagttgacggctttctttctttcttttttttttttgagatgacagctttcatgtgccatgttttagggccatcctatttctaatcacagcatatatttaagaagtacttaatttttcctaagtgacttgaaagcatcttaagacaaaaacaccagaagcatccttttctttttctttctttttgttttttgtttttgtttttgtttttgtttgtttttgagagggatgttgccataggggtgttgccatgttggtcaggctagtcttgaactcctgatttcaggtgatccacctgcctcagcctcccaaagtgctgggattacaggcatgagccaccgtgcccggcccggcatccttttctctatcaaaacagtggactccaagggggactaaaagccaacccttgtccccattagaagatatgttattatttccatttattggatgcaaatgtggacaattgtttgagggcatcgccatgcagatctgaggtggcctcccacagtcttctgcccacacctcagtggaggcgtcagagaacgatgttccatgtatcatgtctccacatgtgtgttgatcaggctggaaatactcttaagaaggagaagtttgggtttctgtttctgggaatggagacactgccctgtaatgatcttaagtgactaccccaaggagtgaactgcaggtcaagcatttctcttcctcctagggttgcaagtgacattgtgtggcctgggctgcaggtcacactcattgcaaggcgccatagcacccagcccccaccccacgtcaggcctctgcacctgctgtctcctttgaggtccccactgggaactcttcccggctccttccccagctcaacctcacttcctggcactccggttccaatatcatctccctggagtcttctctctcccctctgccgctctctggttcctgggcctgctacctcctgttgccacgtgattgatgggcatgttcattacttgtgttgttttccccactcagtgctgaccacgtcctgcccaccacgatgttctctgcacgtagagtgtggagtgagcacttggtcaaccgttgtcagtagggaaagatggaaagcagtgggtaaggcaatagcacatatgaatcagttagcattacagtaatactacaggatagaaaccccatgggtgttttcttgtttgcttttgtatcccggggactagaatacctcctgcatgaggtagctggtcagtaatcctgcagcctaagtgagtaaccaggctctgtacctgagaaactgtaaggtaaagaaggttgaaattgtcgtcatgggaggtgcagagatgattgaatagtgaactttggtaggttgactggagccatgaggccccagggggcataagctagtttagcagctctgtgacgtcggaaacctacaggtactgggtccaaggatggagtcattggaacaccccagtgtggcccccgagtagcagcaaggggcatgggccgggaacctatgattctggcacgaaagtgttgaaaagagggactgggtgtctgacctggaggggatgaagtgaagacagagaaccagtccagaaagagagaaactggaagtcacatatcgtaaggaactgctgttgggcacagctgaccaagtgatgaaaaggaggttgtggtgaagaacagggcaactgaaagcacagcttcccagcaggggcagacacaggtggtgatgatgcctgggtgtcctggcaggggtatgctgaggggcgtgagggtaggacatgaaacctggcaaaggaggttaaggcagctggcagagccgtcccacgggggtagggctcatttaggacaaagaaatgggagaagagcaagatgggccctgacgctacaggccccactgaatgaggagaagggcaagctacagcagaagggtgaggagcagccggggctggaagcagctacatgagcaggacccctctaacactccacagttctccaactggcactaaaacttgaatgcaaacaatgtttctcccaaattaagagtggagagaatcagctctttgaataacttagttttttattgcttggctgagaatctctgaaactgtaaaggaccttggtagaataagaggagataaaataagaggagaaaaaagacctgtgggagaacagtgcatcccagtcccctgatgactgccctcctagaataggggcctcatcctcagcccagccttccccctcagagcctgagtggcccctgcccccagcgctccccaacgcacctgacccctcagccaggctggccatgcctgaaggggtggcctgcccctccacacctgtgggtatttctagtcgggtgggacgagagactgagaaaagaaataagacacagagacaaagtatagagaaataacagtgggcccaggggaccggcgctcagcataccaaggacctgcaccagcaccggtctctgagttccctcagtttttattgattattattttcattatttcagcaaaaaggaaagtagtaggagagcagggtgataataaggagaaggtcagcaaaaaacgtgagcaaaagagtctatgtcgtaattaagttcaagggaaggtactatgcctggatgtgcacgtaggccagatttatgtttctctccgcccaaacatctcagtggagtaaagaataacaaggcagcattactgcaaacatgtctcgcctcccgccatagggctgtttttctcctatctcagaattgaacaaatgtacaatcgggttttataccgagacattcagttcccaggggcaggcaggagacagtggccttcctctatctcaactgcaagaggccttcctcttttactaatccacctcagcacagaccctttaccggtgtcgggctggggtacagtcaggtctttctcatcccacgaggccgtatttcagactatcacatggggagaaaccttggacaataccccgctttcaagggcagaggtccctgcggctttctgcagtgcattgtgcccctggtttattgagactagaggatggcgatgacttttaccaagtatactgcttgtaaacgttttgttaacaaggcacgtcctgcacagccctagatcccttaaaccttgatttcatacaacacgtgtttttatgagctccagattggatcaaagtggttaggtcaaagtggctggggcaaagctacaaattgacaacatctcagcaaagcaattattcaaagtacaggtctttttcagaatggagtctcttatgtcttccctttctacatagacacagtgacagtctgatctctctttcttttccctacaatgcccacggtgtcaactccagccttgcactcactgctacctccagacactgccatctccagaaactcctttttcctcttccctgtgctacctggacttctcttggatgggcttgttagtagactggcactcctgaggaaagaatccctgagctttaggacgtatcagttaaaacccctgtctcagtccatttctgccactacaacaagatatcacagattgtcattatttatttatttatttattttgagacagtctcactctgtcacccaggcgggagtgcagtggtgtgatcttggctcactgcaacctctgcctcccgggttccagcgattctcctgcctcagcctcccaagtagctgtgattacagtcgcgtgccaccatgcctggctaattttttgtatttttagtggagatagggtttcaccatgttggccaggctggtcttgaacttctgacctcaggtgattagcctgcctcgacctcccaaagtgctaggattacaggtgtgagccaccacacccggccaaagattgtcatttataaacaacagaattcacttctcacagttcaacaggctgagaaatccaaggttaaggcaccagcagatttggtgtctgatgaggtcacgctctgcttccaagattgctccttgttgctgcatcctcatatggtgaaaggaacaaaagggatgaatggctgtgtctttacatggcataagagatggaaggcccaggcagctctctaaagcctcttttattaatatgagggcattagtcctattcacaagagcagagccctcatgacttagtcacttccctaaaggccccacctcttattaccaccacagtggggattaagtttccacacgaacaatggagggacacaaacattcgaggcatagcaaccttcaaaactgaaaagcatgctggacacagtggctcatgcctgtaatcccagcactttgggaggccaaggcaggaggattgcttgagcccaggagtttgagactagccctgacaacatagcgagacaccttgtctctacagtaaaatttaaacgttagctgggcatggtagtatatacacgtaatcccagctacttgggaggctgagacaggaggatcacttgagcccaggagtttgaggctgcagggagccatgatcactccactgcattccagtctgggcaacaaaatgagaccctgtctcagaaaaaccagccgaacagccaaacaaggaacaaactaaaaagcaaagagaacgaagtctgaataaagcagaaaaggctatccaaggactgtgggacaataacaaaggtgtaacttacttgtaatgagaataccaggagaagaaagggagaaaggaacagaagaaatatttgaagcaataatgaatgagaatttccaccacgttaatgtcagacaccaagccacagatccaagaggttcaaagaatgccaaaaaggataaatgcccagaaaactacacctaggcatatcgtgttcaaactacagaaaatcagagatagagaaaacatcctgaaagaagccagaggaacaagactccaacagaggaacgaagatgagaatgacacgctcacctcctccagccggtaaccaggaaaaagtgtagggagacatgtgaagtgtccagaggaagggaagcaagaccctagaattctgtaccctgagaaattatctgtcacaagtgaagaagaaataaacattttctcaaacaaaaattgaggaaatctgtcagttgacctgccttggaagaaatagcagaagaaattctttagagagaacaaaaatggtgtaggtcagtaacagatccacataaagaaaggaaaccatcagagcaggaataagcaacagtaaaataaaaactcttatttttattattcttagttgatctaacagataaaagtttgttcaaaaccataattactgcatggtgttagactgtgtatacttatgtgcatatctctatctgtgatacacatacacctgcttttatattaatataagtgaaacgaataagcagccactgtcatcatgtcagttgcagtgggtggggggtggtgcatgggtggtggtggtggaagcagctgcaggagtggcagtaacagcggtgggacctctgtgtcccacatccccaaggcagccaactgtgctgccccaacccttgtgtggccaggcaggacctgctcccaggcccagggcctccaccactgcagactctggccccgtgtcaccgctcttgcctgctgatgcagggagggcacaggaaagaggtgaacagtacccggagcccacccctgggagccccctggaacctgtcaccctaagagccgctgtgatggagccaggccgagctgcctgctgacgggagagcagtgcagttgggcacacaggagcaggcagagaggggcccagtggggacctggaacccccaccccggctgtgaggaggcatggccagggctgcacactccacggagcctgtgggagccaggaatgagtgggagccccaccccttctgagttggcatgtcaggagctccctgggtacagctgcagccacctggccatggctgcggacccaggcatgtgtgtggttctgcactctcaggagcccaggaaggccccctgtctccccgcaggctcagaagtgcctgctcccactgcctggcttctccccactgttggcaccagctccgatcttggagaaaagttggggccaagcccaggcactgtcacagcccggctgggtgtgcccacacttagggcagaagtgacatgccagccccttgccacctcagccccctccagatttgggcactgacaagcacaggagggaggctgagggggatgcagaggacagcacagtgctggctgcgtgcctcttggcatgaacagcctgcgtgccatgaacagcaacaggaggcagacggactcctgggcagaaggggtcaggttcctggtgaagccccaccttcaagctggggagggcctgaagcctggggttccagctgcctgtcctgcaagccagagagggaacttgtggtgcttttccctgggtctgcccatggccacccatggaccaatcagcatgcacttcctccacactgaggcccataaaaaccctggactcagccagactctagcagaggatggagatatgatggggagacgatgggctgactagctgcagggaggagctaccctctctgctgagagctgaagaaaggacaggatgaccagctacagaggggagctgcacaccccaaggtctcctctctgctgagagctgagacgtcaggacaaccagcttcagggaggagctaccctctctactgagagctgaacacttgtcaggataccgtggctatggagaggagctgcccactgtgggtctcctctgagctgttctattgttcagtaaagctcctctttgtcttgctcaccctccacttgtctgcgtacctcattcttcctggatgcaggacaagaacttgggacccatcaagtggtggggctaaaagagctgcaacacaagcagggctgaaacatgccccttgttcaccatgctgtgggtgaagaggagaaaagagagaaggagaaaagagctgaggctcttggggggtcccagacctgggagctccctgagccagggctgtgactcccactttggggccctgcagttcctggagcctccaagcttctgggcaccactgcattccccagtgccaactatggaagcttcttgcagtatgcctggtccaggcacagcctcgcagtgagccagcacccatgctggcacctggagctgcccatctcactgcagcagctggcatgactggctgtgcagtgactggaccccacactcactcactcacacacccctcgccactccactccagtctcttcagagggatgggatccaggccagtagcatgagctgagcacagcctgccagtccaagtgggcccagtgggcccgagcaaaattcggcaaaggtgccaccagccacagaggtttccagccagaaaggcaacaccctcaagattcccataacaacaccaatgataaggaacaggagagaggtattcagattattttgtaatataagttactcacactacctgttaagcaatatagtgttatttgaaagtggacttgagttatttgtaagtacatattgcaaatcctagggcagccattaaaaatgtaatgaaagaagtatgactgataaactaagaagggagagaaaatggaatcatataaaatgctcaattaaaaccacaaaaggcagaaaagacaaaaataacaaatatcaagagtaacaaacaaaatagtaacaaatatgatagctatttatccaactatattaatcactttgtaagagtagattaaaaaaaaaaggcccaactatatgttgtccacaagaaaccattttaagtataaagacatatagcttaaaagtaaatgattgaaaaaaatataccatgtcaacacaagtcaaaagaaagctggagtaactatattaattttagagcagacttcaaaacaaggaaagttaaagggaacgataaaatggggtcgattctccaaaaaggcataataatccttaatgtgcaagcacctaacaatagaatatcaaactacttgagatactacaagaaaaaatagatgaatccccttatcacaattggagacttcaacaccccctgtcagaaatgtgcagatccaacaagcagaaaatcagtaaggacatagttgaactcaacgtcatcatcaatcaactagatataattgatatctatcatccaattcatccagcaacaggataatactcattcttctcaagctcacatggaatattcaccaagatagatcatggatcatcttctgggccacaaaacacatattagcaaatttagaagaacagaaataatacaatatctactcttagaccacaatggaattaaactagaagtcaataacaaagataactggaagatcccaaaacatgtgaatattaaacaacaacaatgggggctgggtgcagtagctcacgcctgtaatcccaacaatttgggaggccaaggcaggaggatcacttgagcccaggagcttgagaccagcctgggcaacatagcaagacaccatctccacaaaaaaaaaaaaagtttaattaaccaggcatggtagtgcatgcctgaggtcccacctattagggaggctgaggcagtagatcacgtgagctgagaagtttcagctatgatcatgccactgcactccagcctgggtgacagagtgagaccctgtctcaaaaaaaaaaaaaaaaaatcacataggtcaaagaagaaatttcaagagacatttaaaaatattctgaactaaatgaaaatggaaacacaacttaccataatttgtgggatgcagtgaaagctgtgcttcaagggaaatttagggcattgaatgcatatattagaaaagaagaaagatctaaaatcaataatctaagtttttgctttaagaaactcaaaaaaagaggccaggtgcagtggctcatgcctgtaatcccagccctttacgaggccgaggcgggcggatcatgaggtcaggagatcgagaccatcctggctaacacggtgaaaccccgtctccactaaacatacaaaaaattagacgggtgtggtggtgggcgcctgtagtcccagctgcttgggaggctgaggcaggagaatggcatgaaccccggaggaggagcttgcagtgagccgagattgcgccactgcactccagcctgggcaacagagcgagactcaatctcaaaaaaaaaaaaaaagaaactcaaaaaaagaaaaacaaacccaaagttagaagtaaagaaataataaaaattacagcagaaatcaatgaaattgaaaataggaactcgatagagaaaaatcaataaaacttggttctttaaaagataattctttgggaaaaaaaatcagtaaaatcaataagcctgtagccaggctaactaagaaaaaagaaggaggaggcaaattactaatattttgctattattagtaatattattacttatattactagtatatatgtaataatataactataataactatgttataatataactatattagtaataatattactaatattaaaaagctatgatcatcaagaaaggaaaaaaggagcatcactacaatccctaggatattaaaaggataataaagggatactatgaacaaatttatgcccacaaatttgataacctaaatgaaaagggccaatttcttcaaaggttcaatctgccaaaattcacacaaaatgaaataggcaatctgaatagacccatatctattcaagaaattgaatcaataattaaacttccaaaacagaacactgggcccagatgggttcattggcaaattctattaaacatttaaggaagaaattttacctattctctacaatcgctttcagaggactgaagcagtgggaatacctcctgtatgtattctgtgaagcagcactaccttataaccaaaaccaaagacattacaagaaaacagtaaatcaatatctctcatgaacattgatgcaaaaatccacagcaaaacttagcaaattcgattaaaagtgtataaaaagtattatatgccatgaccaagtgggattcattccaggtatgcaaggctggctcatcattcaaaaatcaatgtaattaatcacatcaatgggctaaaaaaagaaaaatcacatgatcatatcagtagatgcagagaaagcatttaacaaaatccaacattcattcatgatttttaaaatcccaataaaccaagaataaaggaaactagaagttgaggaaaactttctcaacttgataaagaatatctccaggctgggcatggtggctcgccctgtaatcagaacactttgggtggctgaagagggaggatcacttgagcccaggagtttgagaacagcttgagcaacatagcaagaccccatctttacaaaagaatttttaaaattagctaggcggtggctcatgtttgccatcctagctacttgggaagtggagatgggaggatcacttgagctcaggagtttgagattacagtgagctatgattgcatcactgcactccaacctggaagacagagggaggccccgtcttaaaaaaaaaaggaatatctgaaaaacaacctctacctaacatcatacttaatactgagaaacttgaagctttctcactaagatcaggaacaaggcactcaccactcctctcaccactcctcttaaacatcgtaacattgtactgaaaatgttagatactgcaataaggcaagaaaaggaaataaaagatatagtgattaggaaggaggaaataaagctgtctttgatggcagatgacatgatcatctatgtagaaaataccaaataatcaataaaaagacatgtggaaggaataaacaattatagcaaggatgaaggatataaggttaatctacaaaagtcaatcactttcctatacaccagcaagtgacgactgagattaaaaacatgataacaattatattagcacccaaaaagtgaaatacttaggtataaattgaacaaaatatgtgcaagatctgtataaagaaaactacaaaactctgataaatgtaaataaatggagagatattttatgttaatggataggaagatacaatattgtcaaaatgttagttctttccaatttgatctatagattcaatgcaatcccaataaaaatcccagcaagttgttttgttgatatcagcaaactcattctgatgtttatacggagaggcaaaaggcccagaaaagccaatttaatattgaaggaaaagaacaaagttgaaggactgaaactcatggactttgagacttattaaaagctatgatcatcaacacagtgtggtattaatgaaagaataggcaaatcatcaactgatctttgacacagcaacaaaggcaatacagtagagcaaagacagccttttcacaaatggtgctgggacaacagaacatccacatggaagaagaggaatccagacacagaccttacagccttcacaaaatttaactcaaaatggatcatagacataaatttaaaatgcaaaaaaagtataaaactcctagaaaataatataagagaacacctagaggaccatgagtatgggaatgacttttttttttaaatcagcaagcagagctggcaagaaataggtttttagacacaatgccaatggcatgatctatgaaagaaattattgacaagctgaacttcattaaaattaaaagcttctgctctgtgaaagacaatgtctggagaatcaggagacatctatagactgggagaaaatattcgcaaaagatacgtctgataaaagactgtttccaaaatacataaagaactcttaaaactcaacaataagaaactaaacaatccaatttaaaaattaggccaaagaccttagcagacacctcaccaaagaaaatatataggtggcaaataaacatatgaaaaatgctccacatcttatgcatgagggaaatgcaaattaaaacaataatggccaaaatccagaacactgacaacaccaaatactgtcaaggatgtggagtaacaggaactcattcatttctgatgggaattcaaaatcatacagctgctttggaagacaaaatggcagttgcttacaaaactaaacatactattaccatacaatccagcaattttgctccttggagttgaaaacttttgcccacacaaaaacctgcacatggatgtttatagtagctttattcataattgcctaaacttggaagtaaaaaagatgtcattcagtaggtaaatggataaataaaccacggtacacccagacaatggaatatcattcaattctaaaaagaaatgagctatcaaatatgaaaaaacatggaagaaccttaactgcatattattaattgaaaggagccaatgctaaaagactgcatactatattattctaacactatgacattctggaaaaggcaaagtttactatggagacagtaaaaagatacgggtgggtgggtgggtggggggaggaaggaagagctggagcacagaggatttttagggccatgaaaatatgctgtatgataatgcagtgacggatacctgttattgtacatgtgtccagactcatagaatatgtgacaccaagagtgaaccctaacgtaaactatgggttttaggtaattatgatgtgtcaatgtaggttcatcgattgtaacaaacataccactctggaggggcatgttgataatgggggaggttatgcatgtgtggatgcagagggtatatgggaaatatctgtacctttctctcaattttgttgtgaacctaaaagttctctttaaaaaatcatttaaaattttttttaaatcgcaaacaaaaacacaacataaaaggactgtgttaccaaaattggcttctgaagagaaagtccaaacagaccagttatcagacagttatctatagtttcataagaaaattataccaaacatttgatgatcagaaaatccaatcctgcttaaattgttccagtgcagggagaaagaaaattttctaatttatgaagcaaataggagacattgatcccaaaacatgacaaatacttcaccaaaaaagtaaaaaaacacaaatcaatctcacgtatgaatatcaatatgaagacaaaaacattcataaaataatatcaaacaaaatctgaagcacactttaaataatcttaaccaaggaaattccatagatgcaagggtgattccatatgaggaaagccactaatataatttaccacaataataggctgaggaaaaaattatacaattggttccatagaggcagaaaatattttgacacaattcaacacccatttatgccaaaaaacaagcaataaaatagaaattacaatgatatgtccctaacatgataaaatactaattaatatctcacctcaaagccagtatcttaattaatagaaaaacactaaaagtgttccttctatggtaatagataaaacaaggatgcctactatctcttacaatttctaaattgtattggaggtgttagtcaatgcaattagacaagataaatccattagaggcataaaaatattttacaatagatattttatttgtaaatgaaattcctaagtatctggaaaaaaacaaaacaatcaatggaaaaactactaaaaacaaaaaataaattagtaaagataattagggcagaatagaatattcagatagatttaattgcatatgaaaatttagaaaacaataaaagcagtgtctgtattagtccatttgtgatgctataacagaatgcccagactgggtaatttataaagaacagaattttatttctcacagttccagagactgggaagtccaaaatcaaggcactggcagctggtgtctggtgaggatcttcttgctgtgtcctcatatggcagatggtggaagggcaaaaagtgatggactctgtgtccccatgtagcagaagagcatgagagaccccactcccaaaagccctttttatagtgacattaatccatttaggaaggcaggcctcaccttctaacactgttgcagtggatattaagtttccaacacataaattttggagaatatatttatatatagcagtatcttagactgtttgggctgctataacaaaacactataagctggtgatgtacaaacaataaaaacttatttctcgcagtgctggaggctgggaagtccaaggtcaaggagttggcaaatgtgtttgtagagacaaagtttcaccatgttggccaggctgctcttgaactcctgacctcagatgatccatctgcctcggcctcccagagtgctgggattacaggtgtgaaccactgcaccttgccaaagttaatacaatagactgaaacatgtcaaatatgttttaacattttacttcctaatgtcttttaaaaaaacaaaacaaaacacctcactagtcacctttggaaggtactaagaaccaactcactattttgaaattggcaaatagagaaaacctagtaagtttcttgccagtgcaaagcttttctttacagaagtattccagcaaacaaatacagattgaatgatggaattagaatatctccacttttcaaaccataatgaagtaatggatctaggatcattcactgctgctaacatcacaaggtagagacaagcaaaaatttgtacctgccaataaaatgtcaagataccacctgtggtttatcaaggaaaaagaaaaatgaacctgaatttctaactgccaatatacagaaaatgtcaggcatgtgatcagcaaaatccagactcagaaactctacaggacaaattctctggatttctcatagcaaattgcagggagaaaaacagggaaattgtacattagacgtaaaagatgtacgaccagtggcaatataggcctttttacgtgagtcctgagtcaaacatggaagggaggagggtggaagggagatcgggtctccattttttatactaataagcactctgttgggggcactcatttcccccccaagagcattctttgatgattttgccaaaaccaatctttacaatgatggttacaaaatggtgatttttcgaccacaccactgcttctacgtttaccaactggcattttgctgtaaggaaacactcccttccccccgtacctaatgtttaaattaaacaagaagcaacatcagataacattaaggggttcaaaaggccttggtcaacaagttctgccaccaggcaagctagtgtgacatttttaataacagttatgttctcaaatctttatctggagcttgaagaaacttgcttctagaaagctctgtgtaggcatctcagattaaacatagttaactcagaatttcctgtccatgccccaaacccactcaccaccttctctgtcttagtgtcacctggtatgaaaactgaaagcagagggcattcttcatgccttcctttcccttcacccccgccccacacatgtacaccgcacctgggcctggatcttgccacctccccgcccagtggccccacagccctgggcatgctgcaggcccaggtctcctccctggatgaccacaggagccttggcattggcctccctgccttccttcaggcttctcttcgttcacacgtagtgacagaggagcctgtaaaaagtgaccatgtgaccatgtcactcctctgcctctattttcaatggttccctttcctttggggaccaagttgcagctcctaagtgtgctctgtgaacacgtctccatctgcccctttctccacctcctgacatctcgctgcatcttctccaccctctgtgctgtcaccacattgcacgtgggttcagtccccagcctggctatccttctccatgtgctgggggtttcttcctccactggggagtttcccaatgctgtcgccttcaggttatccgtgagcaggtcccgtagttaactatctataaaggaatgtctagaatatgcggggattcctttttattgcaagcagtgatacatacaggtctcatgcatttaacctgtcacattttaaatataaatgtttcccttatttgtaccttttctaagtggaaactttagagattgttgtacagctaatgcctaaggtgctcatcctgaaatactggtggagagcttggaaattaaagtgaggtggatgcagggacataactcactgtataaaaggcctcctggcagctgggtgcagtggctcacgcctgtaatcccagcactttgggaggccgaggcaggtggatcacaaggtcagaaaatcgagaccatcctggctaatgcgttgaaaccctgtctctactaaaaattacaaaaaaaaaaaaaaaaactagctgggcatggtggcgggcgcctgtagtcccagctactcgggaggctgaggcaggagaatggcatgaacccggcagacggagcttgcagtgagccaagattgcgccactatgctccagcctgggcaacagagcgagactcaaaaaaaaaaaaaaaaaaaagcctcttggcaatagagtgcagactagaaatgtcaccaggtgttggcatttaacaaattctcaccctgcacccacttaattctgtcttttaaaagggcaatagaggctcatttctgagggtgcctggcttcctccaggggatactcggattccaaatctaagcacgagcctctttcagaacttcaggccgtgtgctgacatggaatccctggtgccacgaaagaccccagagcagcacaatctgagctcactctgtttccaatactgcgcccaggtaacgctgcctcctcatgccacaggtccagagcgcccagccgctggtagacacccgcgccccgctgacgttccgccatctccacctgaaactcaagaggctgaaggtacactttcatttctaccttacttaatgtaatagctaactagaaaatgccagcttaaaagcccaggaaaatagaaaaggcagggttagtaaggaataaactcaccgaagacaaaatgcagtctaggtgattaattagccccgtctgtccgtgagggagctggttgataattggagcagaaatctttccccagtcgttgtgctgactataaaccaaaaattatctgagacaggtctcaatcaatttagaagtttattttgccaagtttaaggatctgcccgtgacacagccccaggaagtccttgaaaacatgttcccaaggtggtcaagatacagcttggttttatacattttagggagacttgagacgtcaatcaatacgtgtaaggtgtacattggtttcgtccagaaaggcaggacaacttggagtgggagcaggggtacttccaggtcacaggtggattcaaagatttcctgactgccaattggttgaaagaatttatctaaagacctggaatcaatagaagggagtgtctaggttaagacaaggggttgtggagaccgaaattcttatcatgcagatgaagcctccaggtagcaggcttcaggggaaatagactgtaaatattgctcatcagagttaaaaaggtgccagactaagtaaattctctcctggatcaggaaaaagacctggaaagggaaggagattctctacagaatgtagattttccccacaagagacagctttgcagggccattttgaaatatgtcaaataaatatattttggggtaaaatagttatatattttttaaacacctgctatctatcatgttggtatcttattgctacaaagagtctttttgtcagttttaaggtctctgttttaaccttaatgctggtcagttgtgcctaaattccattgggagcagggcataatgaggcatgtccaaccccacttcccatcatggcctgaactagtttgtcaggttaacttaggaatgcccttggccaagaggaggggtctgttcagttggctgggagttgtggagggggcttagaattttatttgtggtttacatgacccatcatgtcttggggggaagggaagtggattcacagtgacaatttattcagtgcagttccagaataactagcatcattcccttacagtaaaccatttcttaaccacctcagaatgttgggttttgggtttgtttgtttttgagatagagtctcactgtgtcgcccaggctggagtccagtgatacaacttcagctcactgcagcctctgcctcccaggtgcaagtgattctcctgcctcagcctgccgagtagctgggattacaggcgcacccaccatcaagccctgctaattttcgtgtttttagtagtgatggggtttcaccatgttggccaggctggtctcaaactcctgacttcaggtgatctgcccgcctcggcctcctgaaatgctgggattacaggtgttgtttatttcttttttcttttctttttttattttgttttttagacggagtctcgctctgttgcctggctggtgtgcagtggcacgatctcggctcactgcaacctccgcctcccgggttcaagcgattcccctgcctcagcctctccagtacctgggactacaggcccgcaccaccacgcccggctaattttttgtattttagtagacacagggtttcaccatgttggccaggatggtctgatctcctgacctcgtgaagtttacctcatttggtgattgagaattgcatggttatctcgaagtaatgcctccaggacaaaaggctgtgggctttatatgagcctgttaagcagtggtgttaaaatgggctgaactgaagccgagtaaccagtctccagcatatctgcagaccgaccacttggaagcctaaaacaagaggcagattcttttcctctgggctcaaatattctcttcttataactgaataaaatatctctatctttcttaaaatataaaaaagatttcctcattagcaccaccgccacatgttacttttggagggtcacctaattttacaagatagtgcctcgcctcagtgttactctcacttactccacccaatgcgttccaatccatgggcaaagcagctggtggtccccgctgaggggtgacggcgcgtccccgtgtttacggtccccgctgaggcgtgacagtgggtccccgtgcgtacggtccccgctgaggggtgacggcgcgtccccgtgtgtacagtccccgctgaggggtgacggcgcgtccccgtgcttacggtccctgctgaggcgtgacagtgggtccccgtgtgtacggtccccgctgaggcgtgacagcgcgtccccgtgtgtacggtccccgctgaggggtgacggcgcgtccccgtgtgtacggtccccaccgaggggtgacggcgcgtccccgtgtgtacggtccccgctgaggtgtgatggcgcgtccccgtgggtacggtccccactgaggcgtgacagcgcgtccccgtgtgtacggtccccgccgaggggtgacggcgcgtccccgtgggtacggtccccgctgaggcgtgacggcgcgtccccgtgtgtacggtccccgctgaggcgtgacggcgcgtccccgtgggtacggtccccactgaggcgtgacggcgcgtccccgtgtgtacggtccccgccgaggcgtgacggcgcgtccccgtgtgtacggtccccgccgaggcgtgacggcgcgtccccgtgggtacggtccccactgaggcgtgacggcgcttccccgtgggtacggtccccgccgaggcgtgacggcgcgtccccgtgggtacggtccccactgaggcgtgacggcgcgtccccgtgggtacggtccccgccgaggcgtgacggcgcgtccccgtgggtacggtccccgccgaggcgtgacggcgcgtccccgtgggtacggtccccactgaggcgtgacggcgcttccccgtgggtacggtccccgccgaggcgtgacggcgcgtccccgtgggtacggtccccactgaggcgtgacggcgcgtccccgtgtgtacggtccccgccgaggcgtgacggcgcgtccccgtgcttacggtccccgctgaggcgtgacggcgcgtccccgtgcgtacggtccccgccgaggcgtgacggcgcgtccccgtgcttacggtccccgctgaggcgtgacggcgcgtccccgtgcgtacggtccccgctgaggggtgacggcgcgtccccgtgcgtacggtccccgctgaggggtgacggcgcgtccccgtgcgtacggtccccgctgaggcgtgacggcgcgtccccgtgcgtacggtccccgatgaggggtgacggcgcgtccccgtgcttacggtccccgatgaggcgtgacggcgcgtccccgtgcttacggtccccgatgaggcgtgacggcgcgtccccgtgcttacggtccccgatgaggcgtgacggcgcgtccccgtgcttacggtccccgatgaggcgtgacggcgcgtccctgtgcttacggtccccgatgaggggtgacagtgggtccctgtgtgttcggtccccgcttaggggtgacggcgtgtccccgtgcttacggtccccgctgaggcgtaacagggcgtcccctcgcgtacggtccctgctgaggcgtgacagtgggtccctgtgtgttcggtccccgctgaggcgtgatggcgcactcgccgatatgagacgaggcagcgtaaaactcccagggcactcaagtcacagaaacgtggcgtgaggaagagcctcgcaatctgccggcgctcctccagcctccttctctgtccccagctggaggaggaacggctctccgtcatcgagagggacaaccgcctgctcctggagaaggtggcctctgtcatgaggaccaggggacagactgacagcaaaaacaactccaagcacaggaggtaagggagcggctcctgccatcccacccggctcagcaccaaacccgagtgctgggaaggggttggggatgagcagaagagctgcccgtgggtgggagtcgaggcgtttctgtcctctcccgaaaacagccacagctctgaggagtgcccttttccttggcggattgtgattccaagttttacttgagactcctaggctgtttccgcaacccacaactaaatcacagttagcggctgtgagctgcccgtgtgccagacactcctctgaacctgctaagcgcttgactcagaaccctcacaggaccccgtgtggtacgggctcttgtgcacctcacaggacagtaggaaacggaggcactgggaggtggcagaacttggccaaggttgcagttcggcggcggaggaacacaggctgtaccccagccctgctcatgcagttctcaaaggtgtcaagttaccaaaagcagcaaaaggttttgtttctctgtcagcagaccactaggtccagcatctttctggaaaaaacaccgaaaatcatgtacccctgcatcctgtgtgggtcccagcctgggatactggtactgctctttcataacctcacttttcacccagaagtggagttctgccctctgtgaaaatgaatatcagcaggctttcatactccttaaaatcaccttataaatgcttgactgtgaatcctaaaagcctctcttgtctaaggtcaataacctctgccccctgcatcttacacatcctagagtaacctcatagttacaccatggccctttccctgtaagtgcaagattttgatggtgattgtgatagttaattctaatgaaggggtttttgttccggaagtgcttgaaccttttaagacttttggcctgtacctatccccaagaagcttatagtagtttcagatttcataataaattaaaatataattgatcctcaggtacctcgaggtgtgtgatacaggaagattgcaggcccagcagggtgcaccactgggaaggtgctgctccaagctcaggcgggccctgcatggtcctgtgtgctggctttgttcaaaggcccaactggagcaaacctgcctcagagatgatttactgtgggcttccagggcttcaagggaagccatgggaaagtcaaccatttttctcaagaatgcatcagtttggggcttgataactggctatttcatgtctcagttgactccattctttaacaaaggacacttgccgagttaatgcacaatgctggagagaaacagttcgttttcaggggagtctcagctgcttctggagcactgcagaccagttggttgatggaataaacatatctagctagctggtcagccagtagcacaaatcaacatgagagaaactatagagccaacaattggactttcactcctgatttcatttttcatgtctttattcagatgtgattggcatacagtaaacacatattcaaagtgtatgtgataggtttgtcatatgatacacccatgacaccagcaccccagtcaagacagtaaacatattcatcactccccaggtttccctgagcctttcggtccccctacccaccaccctctgcccatcgaaggttccctatgggtgcctttgcactttctggattttatgtgtataggttcatcaagtatctgcgttttgtctgcctttcagttagcataacgttgagtagtgttccatcgtacggatctatcacaatgtgtttatccattcacctgttgatgagcatttgggtggtttccagttttgggctattacaaataaggctgcaatcagagtttatgtaaaaagaaattcagagatgaatacctctgcccaagactgaaaactcaatgacaaatggatttcaagtgggatccacatgagagacccccagaatgaccgcatgaggagctctctcaacccactccccagcaaaacttttgaaaatggttaaaacacagtcatttagagtctctgctgtatggtcctaagaagaaacatatattcaagaaaagctactgtaatttgacaagaacagcaaatgtccctggtatatgagctaaaacctgctgtctccccactgcttccagctcagcaatgcagatgcacaccagaagctgcagccaagtgcatgggctctgctccccacagctcctagtcgaagggccttcttcctggaaggggcagggccttacttttctcatcttgtctgcagttgcctgttgctgagactaaatcccaggtgagtgtggccccacgctggagatgctcttgttctgcccatttcctgtttgtggagtggatgcttagcctgcagccttgggaatggtgatcctaagactacaggagccaagatccccttggtctggttcataggcattggttccatgctgggagagtcacgccgagaagacctgtgtgtccctccaacacacacacacagtggagcacagagcctggggtgtcactcagagagaagatcgccattgttcccactccgagctccagggctctgagattttgcccagaggaagaagcagaccctcgtaacagctcccattctcttcccaaagggatggtttaatttgcaacagaatttagaaaagtgcaagcctcactggacatgaaaataaaagacatcgaaattgggaaggaagaagcaaactatttctattcacagatgatatgatcttgcatatagaaaatcttaaggaatgcactaaaaagctgtagaactaatccacaagttcaacaaggttgcagaatacaagatcaatacacaaaaatcaattgtgtttttatatacttgcaatgagcaatctgaagaggaaactaagaaaacaattccatactcaaaagtatcaaaagaataggtacttaggaataaacaaaggaagtacaaaatttatactccaaaaactacaaaccgtcatccacaaaaattgaagatctaaataaatggaaaaatatcccacgtgtatggattcagaagtcttgctatattaagatggcaatatacaaactattgcagaattttgctccttagttcagctgaaactgggtacttgtcacatgaccaggaaaatctaggcacacgaacacattgaagggtgagtagagcaggattttcttgggtgacaagggaaaaaaagaaaagaaaaagaaaactcagcaaagtgagatggagtcctgctaacaggctcccacctcacaaatggaatcccaggccaccacacaggaactgaagaggccaggctcctcccctgcccgtggcttcacccgtttccccagtgcgcatgtgggcatgtgcagacaaggccctgggcaggttccctcatctgcacaaaagcatctggtgtaaacacttgtcagatggggcagagattctgggcatttggctgtctcaaacccaatctacaaattcaatacaatcccaattagaactccagccaacttctctgtagaaattgacccactggttctaaaatttgatggattgttttagtcaaaacaatcctgaaaaagaagatcaaagtagtaggactcatgtgtccttattgttgctggggagcaatggctatctcagccagtggcatgggggtaatgaatttaccaagacagttgtaggtaaagaaaggcagatttatgagagaaagtaggaaaatacatttcgaggaggcagcgggcagcccacaggagagaggctgactatgaggagaccaaggcttgctggggattttatagggtggcatttatgctgaagagggctttgtgcagtaccaataacaccaaagctacagtgagctaacttgcaggtgtctggtaatagctcggcacaggaaaattgtgagctgtttgcgcaggagggctgcgtgttctggaccatgaagaaaggcagacttgtcgcttacctgctttatctctttgctttcccttggtcccaccagcttgactcctctttcctaattaggactccacacctatttcaaacttactaagaaagctatagtaatcaagatagtattacactggcattaagatagacatataaatcaatgggagtccatgtgtctataatcaatgtattttcaacaaaggggccaagaccattcagtgaggaaagaatagtctttccacaaatgctgagacaactctatcgccacatgcaaaagaatgaagttggactctcacctcacaccatatagaagaattaatcaaaaacggatcaaaggcctaaatgtaagaactaaaaccataaaactcttagaagaaaacagtgggaaatcatcgtgacttcagatttggcaatggagtctaagatatggcaccaaaagcaggaatgacaaacaagaagatacataaactggacttaatgaaaattaacaacttttgtgcatcaaaggacactatcaagaaagtaaaaaaaacccacagaatgggagaaaatatttgcaaatcagatacgattagggacttgcatctagaatacatgaagacctctcacagttcagtgataaagacaatgacctcattaaaagatgggcagaagatctgaatagacatttctccaaggaagacatacagatgattaataagcacatgaaaagatacttagcatcattcatcatcaaggaaatgcaaatcgaaaccacaacgtgatagcacttcacgcctatcagattgactggaatcaaaatgacagataagaaggagtgttggtgaccatgtggggaaattggaaccctccagggctgggaggaatggtgcagccacttgggaaaacagtccagaagttcctcaagtgattaaacatattttaataaatatatggggattaaatatatttaccatataaccaatttcactcccaagtatataaccaagagaaatgaaaacatgtctacacgaaaacatatacaattgatttttgtgtattgatcttatattctgcaaccttgttgaacttgtggattagttctacagctttttagtgcattccttaagattttctatatgcaagatcatatcatctgtgaatagaaatagtttgcttcttctttcccaatttggatgtcttttattttcatgttcagtgagggttgaacttctctaaattctgttgcaagtgaaacagcatttagaacagctcgtccctttgggaagagctgggagtggagacaatggcaatcttctctctgagtgacaccccaggctctttgcttcattgtgtgtatgttgtggggacacacaggtcttctgggcttgcctctcccatcttggaaccaatgcctgtgaaccagcccaaggggatccgggctcctgtattcttagaagcacaatttccaaggctctaggctgatcctccattccataaacaggggctgggcagaacaatgccacactcacctgggacttagtctcagcaacaggcagttgaggacaagaggagaaaagctgaggccctgcctcttccaggaaggaggcccttcgactagaagctatggggagtagagcctgtgtgcctggctgcagcctctggagtgcagtctgcattgccgagctgggaacagcagggaaagagcaggtttcagctcaaatgccagagacatttgccaaattacagtagctttttttcttttcctttttttttttttttttgagacaaagtcttgctttgttgcccaggctggagtgcagtggcacaatctcggctcactgcaacctccacctcccagttcaagtgattctcctgcctcagcctcccgagtagctgggattacaggcgcgtgccaccacacctggctaatttttgtatctttagtagagacagggtttcgccatgttggccaggctggtcttgaactcttgacctcagatgatctgcccacctcagcctcccaaagtgctgggattacaggcgtgagccaccgctcctggccagtagctttttttaaataaatgtttcttcttaggaccatacagcggagactttgaaccctaaccctaaccatataatggaatattgcccagctatgaaatggaataaagtattgacacgggctacaacatggatgaactttgaaaacatgctaagtgaaagaaggcagtcacaaaagaccacatattagacgattccacgtatatgaaacaaatctatagaaacagaaagtagatcagtggttgcttaaggcaagggtatggaggggtagcaagatgataaagggtccagggctccctaaggaagtgatgaaaatcttctcaactgactgttgaggactgtgggcgtctccccattgaactgcacacgataaatgagtgacttgtatggtatgtgaactgtatctcaaggaagaatctcactgcttttgggggcttctaagacccacagcccattcaccaaacctactgcaaatggcaagggaccagggtcactggattctggccttctctggtcagctggatgtgtatggatgctcctgtatgggatcagggaggagttcttgccttaaagggacaggcattgaaatgccaacaaaaagggacccctcccagacccagtgcaattcctgaggggataaaagaaagaagctgtggccctggcacaggctgccaagcatcaccaccgcatggcagcagtgtccccgcatccacctggtgtgggcaaggcacaagctcagcctgagccccatctgctcccctgccgctgcaagggcagcaccatgcagggcacacagaaagtcctcagggctcgcaaaccagaaagtatctagacaggtctcaaacaatctaggggtttatttgccaccattgaggacgctactgggatacggcatggacagcgaggggaggggtcccgttcttgtgaagcttgatattacattgtaatatagaatgaagtaattatacaactcaacatcatgtagaatcagtgggagccctgagtttgttttcctgcaactagatggtcccatctagggatcgtgtggagacagtgacagatcatcaggcattagattttcataaggaacacgcagcttagatctctcgaacgtgcagttcacaatagggttcacactcctatgacaatctaatggcactgctgatctgacaggaggtggagctcaggcagtaatgccagcaatggggagtggctgtgaatacagatgaagcttcgctccctcgcctgctgctcacctcctgctgtttggcctggttcctaacaggccacagactggtatgggtccatggcccgggggttggggacctctgccttatagggaaaactgattagatcattgttctttgcttgtaaatgttctcatgtagccaactagactttgtcaccaccaccatttttttccctagagaggctatgtggtggcttttaatcccattttggctctacaactcaggtccaaaatatgtcccatgctcttcctctaagagaagacattggccagaaagcaaggagaagctgtatccagaaagtaaagaatctgtaatcaatgcatctccttgggtcactcggcagtttcaacattccatggagctggtaagatctgtgagccaggctcttggtgggacctcagctcactctgccgtctctcccagctttagacctgggcttcacgacttctagctgtgtgaccttggacaaattgtcaggttctctgctccttggtttccccatgtataaaataggaactcctgtgcctttcttgtaggcttgtcatgagaatgaaatgagttaatacatgcaaatgcttagtgctcagcactcaataaaagtcagccaatatcgttgttgctattagcttcttcatatttcaaatacggatttctttaactttttcgtgccacgacctgctttggaagaatggtgacgtcatagactcctgaaagcagtgtgcttaaatgaatagaataaaatccacacaatttgacaggcagccaattatattgaagcacgttatcaaaataattctttaaccatgacaaaataattcatgtgcttatttattaccatattaaataacagaaccctgcagcaggccctatagccaccaaaattcacctaagtgataagtatgaataatgttccaaaaataagcaccaactgtaatatctgaagtttctcttggtgataaagtcataggttaccgtgtttgttgcctccaattataatggaagaaaatgctgaattacagctaaaaactggtgaaaatatgacgcaattgctttcctatccaggttcatggatgcctgaattctatccatggttttctggactatgtgccaaatctcccagcccatgtctctaggatttggctctggctgggacgactttgggaaccttgctatgtgtccagttttctatacagaagcctggacaagaaccccttcctttgggctgccagaaaccacaagatgcgagttctccctgccgcctccaatatgaataagcaggtccacaaccaaagacagcctcatccctcagagaattaaataggacccctttggtttttggatatagaaggtgatttttaaagcctggaggagaatttggctaaatgaaaatttagggaggaaggaagacaaatgaagccagctaccgattactcatgaaaagaaaagagaagaaagcaagcaaggataatccacaaagaatggataatagagaaacattccctttctgctgccgtgaggaccacagtgaaacaggagctcgcttgccactgccatctgggcaccatcccgctgtccgcatccaacacagctaatttgctccagtgaaacttcaagtagccaaagtcatcatttaagcacagtaaaagaaagagaagacttaattggatgacatcaatttgcacaataacacgagtaggtggtctcatagaagaccagataataaagtgaacaggtctgcctggaataataacaaaggtgtcagttaaaacgatgtctcaagtacaacacctttctcctccgtgtctcaggggcccttcctggtatgtgaaaagaaatctagagtgttcgtgtaggcctagctcttactcagctttcagccttcacctaaatgtcacatggagaggaaggtcctgatggtctagaggaaggaaggtctagaggaaggtcctgatgcccaccagtgtggcgctcattctgtgctcgttctggctccaccgttgtgtcttcctttaccacgggcaccacagttgtcatccaagcagccaaagtcatcatttaagcacggtaaaagaaagcacagtcacttacttgtgtgttgacctgtctactgtctgtcttcccactgaatctcaagccttatgattccagggactttgtctcttttgtttatcattgtagactcaatgcccaggccaatgctcggcacatagtaggtactcagtaaatatttgttgaatgactgaacaatcaaatgaggtcaccagtgacttcccagttgctcaatttattgaattgtttccttttaaagtttaaaaaataatgtttttattgttcctgattataacataatacatatttatggataccaagaagaaatttaactatcatttcatcacccagagagaatactttttgtatattttctgcattttgtatatttttgtatattttctgcatttccaaatatataatagagttatatttttgtgcacatatatgtattaagtataattaaaattgtaccttatatgtgatcttatatcctggcttaagactttttacatctcattgaaacttttgaacaccacttcaatgggttcatcactttcttaatcagttccatattattaaaaattaattcagaattttcactattatcagtgatgctgaaagggacacttttatgcattaatttcatgtggactcttccatcctactctttttatgttgagtgactttgctgattttgacccactgtatttgaccctcataaaatgtcagtttagtttgatccgatctaacccttgacctttctgcagcttttaacattagcatccttgcccctcctggttgtaattcactcctgactttctgcacttcctacctccctcactgttttcttctgccctattttcttctgctcccgtggctcagcctttggctgcctccctgcctgtctgtcctccatgggcaacgttgcccagcaccacttcgatgctgcagatttgattgcagatccaggtcttcagccctgttgtcactcctgagcaccagcctaccagatggttccacccaaatgttccaccccagctcaagcccagctccagccccaccttggatggcttcagcctccaccaggctgccaacagtgcctccctctcaggtcactcccagggttaaatgagagaagcacatttcattgatacacacacacacacacacacacacacacacacacactttaatggctctgagatggagatgcatcttgcagcacatggtgtgctatggttttccaaaacaacagatgcaatctgtcaccaatgaaatgaaatatgcacaggacagtgcctggcacagaggaagtgcccaacaagtctccagagggtgatggtgaacttccaggaggaggccaccaaccatccaccattattccctgcttccacaaatctccctagttcaccaaactctcagccctaaccctggtgggttctttacttcgtgctcctctgtgctccacagccagggtcaaacccctactctaggcgcttccgcagccccccatggctccctctccatccaatgcagcctcctgaacaggtttcaccggtcccatctcaccactgcagtgggctggcatcgatgcccctccctcccacttcatgctccccagtccagccccagcctgtccacaggggtctttctcaagtgcctgcggagtctggtttgaagccattcagtggctccacactgtcttccacatgtgccagactctgtgcactgctagaccctccaaaatccaacccctgccaacctccctcacctctctcccatgggcgcctgggtgcttgccctccccgcctgggaccctgctctccgccatgggtgcccgggtgctcgccctccctgcctgggaccccactctctcccactcatcttgtccagcatctgctctgctgaccacgctcaggaagcaccgggagacttccccgctgtgccccattgtgctcaccctgaaaacgcccctcccgccgtgcaaagcgagcgcgccggggctgagtgtgcccttcgctcctctctgagccagcagctcccactccagcacctggagaaccggtttcttaaatgttggttcagtgggaagcaggagcaaccctccaccccgggaccccttcctgctctggagcctgttggccctgtggagggaatggcagccttaataaaatccaaatttcaaaatgtgtgtgctctttcgtggagtctgcacagggggaagagagaacaggaacttcgcagagtgcggaagaaaacacggccattctggaaggaatcacacactcagaaccatggtatggagctcaaaggtggtgtgaagactggggcagggctgagaagtcccgggtgctggtgtggaatctccctggagacagcagatacgcctagcaaaaaggtacccgcaccttctttttcatctaaaatccatagctatttgaaatttcccgttttacttcatcagattcatcagaattatgtactcactcattctttgccgtattagagcattttgttcaattgtcagcaaggatatgtcaaatggtcacatcctgtaacaggagatgcaaaacagtcactcagctgatgacctcacccaccacgcatttgttcacgaagttgaggaaattaaaataagctcagctgattgattgtagattgtgagagaaagatttggtgaaaataacttagccagatagtatgcatacaacatcattaacatcaggttggccaggcgcagtggctcacgtctataacccccagcactttgggaggctgaggtaggagcatcgcttgagctgaggagttcgagaccagcctgggaaacatagtgagccactgtctctattaaaaaaagaaaaagaggcagggcatggtggctcatgcctataatcccagcactttgggaggccaaggcgggtggataacgatgtcaggagatggagaccatcctggctaacacagtgaaaccctgtctctactaaaaaaaatacaaaaaattagccaagtatggtggcacaaaattgcaatcccagctactcgggaggctgaggcaggagaatcacttgaacccaggagacggaggttgcagtgagccgagatcttgccactgcactccagcctgggcaacagatcgagactccgtctcaaaataaataaaataaaaattaaaaagaaaaggaaaaaagaaaaaaagaaatcatgtgatgatcctgaattagctgtcccacagaatccaaaatggaaagagttaaaaatttgagtttgtcccacaatttaagttctaaactctcttcattttattcaaattgacaaaattgtaattgtaaaggaagaaccatgagatttaaattttgtcattaatatactgcttataaatatccccaataaatcaaattaattaaagagttttaaagatcttccatcactcgctttacctgtatatataaccgttatattgtggaccattataatgtggaagattgctttccttaaaatccagcccatcataaggaaaaatatgtagacaccaaagattaaataaatgctccaggaccatggaccccacccctgcacaaactccagaaccacagaccccacccctggacaagctcaaggaccacagaccccacccctgtggaagctccaagaccatgaaccccacccctgcacaagctctaggatcacgaatcccacccctatggaaactccaggaccacagaacccatccctgtggaagctccaggaccacagaccccacccctgtggaagctccaggaccacagaccccacccctggacaagctccaggccaatgaaccccacccctgtggaagctccagcaccatgaaccccacccctatggaaactccaggaccacagaacccatccctgtggaagctccaggaccacggatcctacccctggacaagctctaggaccacagacccccacccctgtggaagctccaggaccatgaaccccacccctgcacaagctccaggaccatgaaccctacccctatggaagctccaggaccacagaccccatccctgtggaagctccaggaccacagaccccacccctggacaagctccaggaccacagaccccacccctgtggaagctccaggaccacgaaccccacccctggacaagctccaggaccacaaaccccacccctatggaagctccaggaccacaaaccccacccctggacaagctccaggaccacagacccccacccctatggaagctccaggaccacagaccccatccctgtggaagctccaggaccacagaccccacccgtgtacaagctcctaaccctaaccctaaccctaaccctgaacgagcttcagaaccacagaccccaaccccggacaagttctaggatcacaggctctacccctgcgcacctacttgaagtagcacctcattgccttgccccctgcagtttccacaggtatttgtgctgatgtcagctttgcagtgcttccttccatgcttggtacaacatcgtaagcccagctctgctgcttgctggacatctcttatagaatcccgaagagtgaagagaacaagtacctgtgcaaagacgcatgactgttaagcagctactaactctgaaggcattcagaaaatctagtctgctttgcaatttacattgaaattttaaacatttcaagtccaatcaattttctcaaatcttttaactacaaagctaatatttgctttctgtaaaccataaaatgtcaaacagtatagagggtgtaaggaacatgggagtcttctcttggatggcagcccctggaagtaatcactgttagcaacttgcatgtgaactttgatttttatttgtcaagtacatatatttgaggttttgtttgtttgtttgtttgttgagatggagtctcactctgtcacccaggctggagtgcagtggcgcgatcttggctcactgcaacttctgccacccaagttcaagtgattctcctgcctcagcctcctcagtagctggggttataggcatgagccactgcacccggccatatttgtttgtttaaacaaaaatggagtcctactctacgtagttttctgtaaattgctcatttcactcaataatgtatcatacaaatagtttcattccatacatgaaagtcttcttcattccttttttagcaattacaaaatattttatacagatttgccttaatttatttaatcagtcccctaattattgaaatttaggttgttttcagtttttcgatattccaagtgaaactatgatgatcatcttaacccatatgtatctttacacaaaattatgctgtaacttatattcctagaaggaaaatggttaaatcaaaggtaagcacatttagattttcaatggataccacctaattgccccccacaaacagtctagcaattttcacctctgcttaaagtggtcccaaagtgtctgtctcctcataattttgccaaccctgggtagtaaatatatttttaaactttggaccatctgatttcttcttgtatgaattgtctgttcatagcctttgaccaaattcttatcatatgttacttttcgttattaatctatagtaagtatatgttatcaatatttaccttttttctattatcaatgtcataagtatctcttccacattattacttatcaattcacctaagtttattttaaggtagtcaaatccatcaataatttcccttatggcatctggtctgtgtgccatacacagaaagggctctctcaagctaagattatgcaagtattctcctgtattctcttctaatactataagttttcttgattacctttcagtttttagtaaatatggaacttaataactatggaatttttgtgtattgtgcaagttagagatcaatgtttattttttcagtttattacaagttattaaaaatcagtttacaatgtcaaaaactctattcttcacacttcatagaaattgttctccagagatttgtagcagtgctttcccatgtcctcaccaacatgaagggttacccgtgggggcactctttgctcatttcactgccaaaagcagtgtctgctttgatgctgtccctctttgactacaggtgagacgctttctccctcactattctctctcacaatgacagatcactgtggtgatgtgtcacaattccatctgtgggctgggctcaggtaggagagtcaaattgctcaggtgcttggcagaggcttatgtcaaagtcaaacctgcaggaagttttggggatgagatttaacaatcccgcacatgtcttgtttctaggtatgagagtcagcacctcctatatgttgggtctaagtacacaagtcacaatctcactagtggactgaattcgtgcatgagagcctcccagagcctcccacctcttctgctggctttgcccttgtgaaatcacagccccacaggtgtgcttctcccagcctgtctgtgtctgcgacactccttctccagggatctcagtgcttttatccacattgtcacctccactgccctcctcccggcttgttttcagacatcattttattttttacttatttattttctgttatactttaagttctagggtacatgtgtacaatgtgcaggtttgttacatatctatatatgtgccatgttggtgtgcctcacccactaacttgtcatctacgttaggtatatctcctaatgctatccctccccactccccccaccccacgacaggccccggtgtgtgacgctaaccttcctgtgtccatgtgttctcattgttcaattcccacctatgaataagaacatgcggtgtttggttttttgaccttgcaatagtttgctgagaatgatggtttccagcttcatccatgtccctacaaaggacatgaactcatccttttttatggctgcatagtattccatggtgcatatgtgccacattttcttaatccagtctgtcattgatggacatttgggttggttccaagtctttgctattgggaatagtgctgcaataaacatacgtgtgcatgtgtctttatagcagcatgatttataatcctttgggtatatgcccagtaatgggatgactgggtcaaatggtatttctagttctagatccttgaggaattgccacactgtcttccacaatggttgaactagtttacagtcccaccaacagtgtaaaagtgttcctatttctccacatcttctccagcacctgttgtttcctgactttttaatgatggccattctaactggtgtgagatggtatctcattgtggttttgatttgcatttctctgatggccagtgatggtgagcattttttcatgtgtctgttggctgcataaatgtcttcttttgagaagtgtctgttcatatgctttgcccactttttgatggggttgaataaagaataaaagagagaagaatcaaatagatgcaataaaaaatgataaaggggatatcaccactgatcccacagaaatacaaactaccatcagagaatactataaacacctctacgcaaataaactagaaaatctagaagaaatggataaattcctggacacatacaccctcccaagactaaaccaggaagaagttgaatccctgaatacaccaataacaggttctgaaattgaggcaataatagcctaccatccaaaaaaagtccaggaccagatggattcacagccgaattctaccagaggtgcaaggaggagctgataccattctttctgaaactattccaatcaatagaaaaagtgggaatcctccctaactcattttatgaggccagcatcatcctgataccaaagcctggcagagacacaacaaagaaagagaattttagaccaatatccctggtgaacatcaatgcaaaaatcctcaataaaatactggcaaaccgaatccagcagcacatcaaaaagcttatccaccatgatcaagtaggcttcatccctgggatgcaagcctggttcaacatatgcaaatcaataaatgtaatccagcatataaacagaactaatgacaaaaaccacatgattatctcaatagatacagaaaaggcctttgacaaaattcaacagcccttcatgctaaaaactctcaataaattcggtattgataggacgtatctcaaaataataagagctatttatgacaaactcacagccaatatcacactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtttgcagatgacgtgattgtatatttagaaaaccccatcatctcaccccaaaatctccttaagctgataagcaacttcagcaaagtctcaggatacaaaatcaatgtgcaaaaatcacaagcattcttatgcaccaatagcagacaaacagagagccaaatcatgagtgaactcccattcacaattgcttcaaagagaataaaatacctaggaatccaacttacaagggatgtgaaggacctcttcaaagagaactataaaccactgctcaacaaaataaaagaagacacaaacaaatggaagaacattccacgctcatggataggaagaatcaatatagtgaaaatggccatactgcccaaggtaatttatagattcaatgccatccccatcaagctaccaatgactttcttcacagaattggaaaaaactactttgaagttcatatggaaccaaaaaagagcccacattgcaaagacaatcctaagccaaaagaacaaagctggaggcatcatgttacctgacttcaaactatactacaaggctacagtaaccaaaacagcatgatactggtaccaaaacagagatatagaccaatggaacagaacagagccctcagaaacaataatacacatctacaaccatttgatctttgacaaacctgacaaaaacaagaaatggggaaaggattccctatttaataaatggtgctgggaaaactggctagccacatgtagaaagctgaaattggatcccttccttacaccttatacaaaaattaattcaagatggattgaagacttaaatgtaagacctaaaaccataaaaagcctagaagaaaacctaggcaataccattcaggacataggcatgggcaaggacttcatgactaaaacaccaaaagcaatggcaacaaaagccaaaattgacaaatgggatctaattaaactaaagaacttctgcacagcaaaagaaactaccatcagagtgaacaggcaacctacggaatgggagaaaatttttgcaatctactcatctgacaaagggctaatatccagaatctacaaagaactcaaacaaatttacatcattttatttttaatatctttgggtcattttattttatattgtctcataaacagaatagcataattttgcattttaacctagtcccagaggctttccccgctcagttttatccatttatatgtattgacataagtatattgtatttgttctcatttctggctcttttgttttcatttccttacttttcctcctcttatattaatactattgagtttttcctcagcaaatgtcaagacagtgcttgcaaccaatgtttcaaatttatacttcatttactttctttggctctcttattcttcctgctttatgtaacaggaaacagataaagcccaccacaaaagcaatgttaagataaagtcaaacaaaaaaagggaaaacagaagcactagaaagagtttcctgcagccacagaccagtcactgcactttattgaagtccccagctttggcaatatggttcaagtgtaggctccaagacagagctggggaggggcaggctcttgcaggacactggctccgaggcatgcctcccccactgccctgtacctggacaaaaacgggaaacatgggaaacgactcattgtctctgaacctcaagctggaattatggtctgtgtgtcccaagaagatggctttctcagcagcatctttaagctcctagggcctttggctcctgtgtgtgagggaggaaggaggcgatgggcccagggccatagggtacctcagtcttcagtccccttctctgccatggggtctgcagttttgaactactggaacgtgaatgcgtctctcggtggtgcttccccaccttggaaacagaccagccacgtaccaagctggcgacgagggagcacggcacacacgtcttctcattttagaaagaaaaacaaagttaatttatttgaaaactgtaggtttaggaaagaaaaatgctaagtgttatgagaccagaaacctgaaacacagccttcagaagaccctcctgggcccagcggccaccttgacctgctgttggaccacctccctatggttcggccagctgccagacctttgggatccgggatctttgctctgggatcttcgctggcctcgcatggatgggacacatcactttacctttatagtcccagaaattcatgacactggcagagaaccccttccctgctctccagagcccaggcccctctcctctgccccaaagcttcacctgacggaggctgtactgctagtctcctggatatctcaatctggtttaaatattaactcgcaaaatttctcaaacattttaaaggaaggatttcaattttccatcctccttaccccttcaagtcatttatccctaactccaaaatgagaagataataattttgtacctgtttctactgaaggatttatataagattatccaacaaaacccactggccatcctggcacttcctggagcccccagctaactggaagtatgcattgctctaatttagtgccccaaccccaataactcctgcacatgagaaagaagcaaaaattaaacaaacacaaatgatctccaggagcaaaattagctgtttaaataatcggctgactcagtgcaggttgacacaggacacacaatggatgtgagttggctttgagctccttggcctccaaccatcatctcggacaaaagctcagcctcggggagccccattctcgcttctaaagatgggacaggaaccacctcctggacctcacgtcagggttaagtgaataacatttgcaaaaatgactgtgaaagtgactcacacttggctgggcatggtggctcatgcctgtaatcccagcacttcgggaggccgagacaggcggatcacgatttcaggagatcgagaccatcctggccaacatggtgaaaccccgtctctactaaaaatacaaaaattagctgagtgtagtggcgtgcgcctgtagtcccagctactcaggaggctgaggcaggaggatcgcttgaaccagggaggcggaggttgcagtgagccgacatcgcgccactgcactccagcttaggcgacagagcgagactacgtctcaaaaaaacaaaaaaacaaaaaaagtgactcacacttacttggcaaaagataaatttgagtttctttcctttttcctcctgaaggccctttaccatccagcaacaagccaacatggctcagtttactgattccgggaaaagtactttgctgcatttcagaaagatgtttaacaacaaaactgacaaaaggttatctgattatttgaatagagatttctcccaacaggatatacaaatggccaataagtgcatgagaagatgttcaatgttattagtaaatgcaaatgaagaccacagtgagatgtcacttgcagccactaacttgtctgcaatcaaaaggtagattacaataaggatgtggagaaactggaaccctcataggctgctggtaggggtaaacagtggtatgtatacatatgtaacaaacctgcacattgtgcacatgtaccctagaacttaaagtgtaataaaaaaaaaaggaaatgaaataaaaggtacacaaacttaaaatgaaaagaaaaaaaaagagtggtgcagccactttggaaaacagtttggtagttcatcaaaaagttaaacagttaccaaatcacccagcaactccactcctaggtctatattcgagagacttgaaaacatacattcatgcaaaaacccatacactgatgttcatagcagcacagttcacaatgaccaagaggtgtaaacaacccaaatgtctatcaactgatgaacagataaaacgtggtatagccatagaatggaatattattctaccataaaaaggaatgatactagttacagaatggataaaccttaaagacattattatgttccgtgaaaaagctggatactaaatgccgcatgttgtctgatcccttttatatgaaatgtccagaataggcacattcaaagagacaaaaagtaatcagtggttgtcggggctgggggaagggaaattggggagtgatcccaaaggagtttgatttttggagggggaggtgatgaagatgttctgaaattatattgtgacaatagttgcacaactctgaatataccaaaacacactaaaatatacactataaaggggtatagaattgtatctaaataaagctgttattttaaaaattgtatgtttaattctaagtaaagacttgtcaatgagttgaaatattccatttcccaagtaagttgatagtttcttgttcttgcctaagaaagcgttagtttcaaatatgtattttaaatccagcaggaagtgaaactggattagcaagcgcacagccaagcctggaccctaaaagagaagtgaggaagggtaaggattcagaacacaaatccagaaagaagacaagtgtgatgagggagtcacaaggaagacccacaaggccagccatgagctcccccaggctaacacagccagcggtctcagggcagtgtggggaatcagccttgcccagggccggggccagggcagccccgctgtcttcctctcttcactgttatcacagccggagcagctgtgaagtgcccaggaggcagctcctcaaacggtgtttcaacaatgtgcccgagcagatgacgcagcaaaactattttctgtgcttcttggactctgataactggaaacaaactatgcagagtcatgttaggaggtgagggtttgaattagattgttttctctagctatgaagacttattctgttactgtattttgagctgtggtggatttgtctataattcctaggtggatttttaacttaccttaaaagctctgtgattgttcctttaacaaatatctaaataaatcagattaaaatttttgaacgtgatgaaactacagcttgactccagaatacataacctaagatataaaaaagacccagagggccaggcacgatggctcacgcctgtaatcccagcactttgaggggccgaggtgggcggatcacaaggtgaggagttcgagaccagcctgaccaacatggtgaaaccccatctctactaaaaatacaaagaagttagccaggcatggtggcgggcacctgtaatcccagctactcagaaggctgaggcaggagaatcgcttgaacctgggagatggaggttgcagtgagccgagaacgcgccactgcactccaaccggggcgacagagcaagactccatctcaaaaaaaaaaaaaaaaagaaagaaaaaagaaaagaaaagaaaagaaaaaaggacccagagagtctcggttggagacatcaagggtatgtctgagagcccttgggatctgcttagttctctatcagccccaggtaagatcccgcctaagctgttccacaacaatgaacatcagcccatgggcaatgccttttaaaaatgagttaaaagactcacacacaccttcattcattcaacagaactctgcatatgtagtctcagcctcatggagctgatagctagcccctcagaaatgtcacggtccctaactactctttgctatttatttatttattatttttattttatttatttattttttgagatggatgggattacaggcacatgcaccaccactcccagctaatttttgtatttttagtagagacggggtttcaccatgttgaccaggctggtcttgaatgcctgacctcaggtgatctgtctgccttggcctcccaaagtactctttgctatttttaacctatattatagatttaaatttttgttttgttttgtttgaatgaaaataagaagataatttcaggctgggcatggtatcgcacacctacattcccagcagtttgggaggccaaggtgggagggtcgcatgagcccaggaattcaagaccagcctgggccacatgatgagaccccgtctctaccaaaaaaaaaaaaaaaaaaaaaaagaagcagcagctaatttcattccttatttcattcctttatgcacaagcccctttaaaatacacttgacatgaatagcagagcttgcctccggctcctccatgcagaattcggcaatcccaggttcctcaccgctcctcagggtggaccttccattgacagtgtttaaaatcacagactgtggggtcagacaggcctggatgtggattctgggtctcctgctgatcccccgagtggacctcccgaagcctctcctgtgcagcaggtggtgctggagcctgagatgccggcatcgggccgggaggagctgggcctctgcccactgcagccatgacctctccaggcagccccgcccccctgtgtcgtgaagcgcaactgggcacaggacctccattaacagtccacgtctgtgctaaacttgatggaaaaaatggcctctccatagcgatttgtgtccttggtttgcaagcctcgaatttgcacctccttttcgaggtggcagtttagggttgactctggcagcattttccgaatgtgcctgcctgtgtgtccccaccttgttccaccccacaagggttgtgctgtaggagtcctggcctctgccagccctccctgatgggccctaatgcaatgaacgtcaaaggatctatcacaaaactagaaaggctgctgtctggtcctgagaacattgttctcttttcaatctctctttccagagagcaaacagtttataaagactgacaaattgctacacatagtcaagaagtagacaaaatcttgccattacacagaagagccataatgtcagctcttttcccttctggactttgctcagagagtcagtggacaaatgagcatcctgccagcagccttagtgtaaaaaccagccacccacaagctctgatgacctgaaaagtcaagtaccaggtgcattttcagatccagagatgtgtctgtcccatgttactctgggtatcaaattaattgaaacctatagaactttgaaatgctttaaaaccatcataaatataatggatggagcagtgaggacagaagcctgtctatcctgtgtgaggtgggcacacaggaaatacgtgttaaatatagaaaggaagaaaataaaggagggagagaagaagggagaagggaaaagaaggtagaaaagtagtcctatagtggaagaggaggggaagagacagaaggaggaggaggaggacagaggagggagggggagggggaagggctagggaggggaggagaagtgaggggggaaaggggaggggaggaaggggaggggggaggggggaggggaaggggagggagggggagggaaagggggaggggagggagggggagggaaagggggaggggagggagggggagggaaagggggaggggaaggagggggagggaaagggggaggggagggaggggggatggaaagggggaggggaggagaagcgaagccgggggagtggaaggggaggggagggagaagagaaggagggaggcaaaaaggggagtgggaggggactggggaggacggacaaggagaaagaaggaggaataagaattgcaggcgtggcccaggctggtactggggtgggggaagggagtgccccctgcagaacaggaggctgttgccctagggtatgcagggctcacctgaggagcctccttcattctgagccctgagcgcctcctctgcctcactccggtccccaccctgcagtggtgaagccaaagtcggtaaagcagtggctgctgtgtgttttctccaggtcagtgggacatggggctgctggacatctcagccctttggccgtggctctgccgagtttgatcgccacactcttccctgctgccaccagaagggtcacacaaggccactctcaggactcccagacctcatctgtctcagagaagaacgaggccactataaaagggtgatgtctttggccttagggggcgtgtaggcccctctggttgcgatgtggatagagttccagatgtgagggaatgttctggaaatgcaacctgggcagctgatggagtccaggcccttcgggtgctaacgctgtgaaacatctctgtttcagaaatgggtgccaagcctggagggcaggcttgcttagcaaagaaggcaaactctggtgagctacagctgggttcagcacatgggtctggtagggaaacacacattgaaacgttattaaaaccagcaagactgacacaggcggcagactgtgacgtctgtcccatgttacactgagcttgttttcaggtccggagatgtgccaaagccgtgccacactgggctggagccactcgtgaaatgtcattacgctcacacagctgcaaagttctcagtatttaccaactaggacttttcttgtattggtatttgtttaattgtcttctctcctcaacagtaactataatgtcctaaaactccgtagacaataaatagttctttaaagaccagatttagttttcatgtaacctacaggttggggaaggggaaccacaaattgcattgaccctcaaaacagtggctgaaatggaaagaactccttaaacggaacccttggggaatccatctgtaaagccccattgcctctcagattctgtgatctgggcctcgagacaaccttcagagtccctcgctgcatgagtgcatgtctggtcagagactttcaaaaactgaaatgccccaggccagcagccatccgctaacaaggaccgtggagaaaagcccatggatgcgtggagaaatggtgcccactagtggcgatctccagaatggacgtcctgtgaagtagatgccgctggccggcggtggctcacacctgccagcacctcaggaggctgatacggcgggggagtgtggggggcggggcgcattgcttgagtctggaaattcaagaccagcccgagcaacacagtgagaccctacctctacaaaacatacaaaaactagccggatgtggtggtgcctatggtcccagctactcaggaggctgaggtgggaagattgcttgagcctgggaggtttaggctgcagtgagcagagatcacaccaacgcactccagcctgggtgactgagggagatcttgtctcaaaaacaaacaaacaaaaaagatccggctgactgaagtacccaggcaaattaaccagacacttggagattttctcattttctacaaggctgaggagaaattttaaggagcccacaattccaacaccccatcactctttctcatgtttttcccaatattttcatcaaatcataaattgtggcaaaataatgtataattctcaatacatacaaagtaactcagaataaggaggactgatcaagaagaatgtaaccaatcaccaagtgccacattcactgaaatcagcaattcataagcatagttatatgtgtggtgttgggcaggggggctgtggtgtgtgtgtgtggtctgtgttgtgtacaccagtgtgtggtgtgtgacgtctgtggggtatgtgtgtggtatgttgtgtgtggactagtgtgcagtgtgtagtgtgtctgtgaggggtgtgcactagtgtgtggtgtgtgtgtctgtggggtgtgtgtgtggtatattgtgtggagtatgtctgttgggtttgcactagtatgtggggtgtggtatgttgtgtgtggtgtgtgtggactagtgtgcgatgtgtagtgtgtctgtgggggggtgtgcaccagtgtggggggtgtgtgtgtgtgtgtctatctccagattagatgatttcctgctttttttcagtgatatactgctgtcatttttaaaaattatcctcagcactatgtttcagacaataatgataacatgtcttggcataagcaagctgtgtgttaataaaatatttttgacactgagcaacacctgtaagcattgcaaactatccagaggcagttgtttttttcacacatcactgtaggaagcttttcctcattcatcttatgggccctcactcactgcgttccagccagactaggtttctttgcattccctgaatgccctgggccttctcccacctccactccctcccctatccactggttcaaccaaatccttcagttccatcttggcgtccgtttgaggaccgccactgtggcctccacaggcgtcaagcctgtgttcgcagggccctccacaatctgcactccgtcacccgctcctggcagaacactggcacaggagaccaaagtacacgtggatgagtcaatcagaagaacaacttgtactagaaagtgctttcccaaatttgacatcaaaattgagaccagtgaacactttcatggctcatgacaaagttcatatccacctaacacaaaacgagggcattattcagttaatttgatatactaaaaagataatcagataaccagctagagattatgacacttctgaattggctgttaccctcatgtcgacggggctggacccgtgtctgtggacagcagtctttgagaagctgcagcgggagcctgtgcaggatgactagtgttgcagtgtcctgggggtggtgggacaggatgctaggaagaaaaggcgtccggcacctcaggatgctctgtccgggtggctcagcttgcttcccgtagcctcccagtccttttactgaagtttcaggaggtgatgcttgggacgccaggcctggcagattcctctccaggcttcccttcaccccgcagagcttccccgcactggcagaactcgatcactgccacccagagggcattgtctctgaagaggcatggagagtggggaagctgcaaaccccaggctgatgttcttggtgtccccacagcctgcttttgccttaaaaccccaggtatactcacaaatgggtacaacacccaagaggccattgtcagctcagggacttggttttaggtgcggctttgggaacttgcttaggtaagttagccttgctgggtcttattttccacatcagtaagtgccacgaagcttaacatttataagccaacagaatgcctcaattttaattaacaaacattaattatcaatcattttttacctggatggaggttaattcaaaggaaaggtattaacccagagggtttttctttttaagagtgttattgtggtgcccatgtcccggcggggaagctctgagcttcctctgcccaactctgcaggcgacgcttatggccccgtctgtggcgtccaggtgcacctggacaggtctccaaggcagcgctggagcagatttgcagccacagggtgtggagaaatgcaagatgaattgagacttgatgtttggatagatgttaattccaaacttgagaactgtctttgtaaaatgacaacaaagacgtatctgccaatcattgacttcttaatcactgcctttgctctttcaaagcctcaacattttgcagtttcagccaacagaattctctaactttgtaaactgctctcctgtggcgacaataccacctcactctaatcagtgagaagggtgattgttctctcttcctttcagagtaatttaaattcttgagaaaccacttggcatgtttaatattctggtcatactgaaaatccaagtcttgttttcctgaccgtatttcaggaactagtttaaggacggaattatcttttaaaaccacaaaacaaagatttttacacactgaatttcacaaaactcagtattgcagaattgcaaacatgctctgtgactcagtctccagggcttaacttcccccttgtagtaactttagagggtcctgaaattttagcttctttaacaagggcaaatactgggagagaatgtaaggggaggaaaataaacagaatgtcttctgttagacaagccagcctctggcatgtacacatttggcagagttctaattttgtttgctaacctccgatcactacctgaaatgggtctctgcaggatatcaaggtgtcagcagcgctgtgctcctggagcatctaggtgagaatcccgtccctggcctttcccagcttcaggaggccacctgcactcccagctcactgttcttccttctttccttcctccatcttcaaagccagcggcgtagcgtcttccagtctctttgactctgaccccccggcctccctctttcacttgtaagaactcttgtgattacatcatacccacccacataacccatcttaacttaatcaccccttgcaaagtccattttgtcgtgtgaggtaatacacaatatttatgagccctatcagtttaaccaattagtaagtgtggtagaggaaatacaacgatggaaggtttaacctgaggaaagaaaaatagctcagagcagtctgaactatttgaaggatgcaaaatgtatcaggacatgagtgtgggactaacttcagtcactctgctccccatgccacaggggcaattgtttaaggcattttgttcctgactgctgtgtcacccattattttcatgtttctggagtctgtgagacaaagaaaaatgtatagtcaatcaatagcttacgttgttttaatgtaaatttttgataaacaactcaggaactgccctttctttcctccttaaaccccccgcccccaaccaggtacctgctgctggttgggtgcatactcagggaaattcaaatctgtgctcccaggtggtcatcctcagggcttgtgctcaaataaactccatgctaactcgtattttctgaatctttctatctaaggttgacaaacctaaggggcatcattctaaaatcagtaaacatgattttgctgtaggctattacaggtatagaagggaagaaaagcacaagaaatctaaccaaatatagagactccaggtcattctattagaatgtgatgtggtttggatctgtgtccccaccaaagctcatgtggaattataatccctgctgctggaggtggggctggtgggaggtggttggatcgtgggggtggagtgcccattgctgctggcggtggggctggtgggaggtggttggatcgtgtgggtggagtgcccattgctgctggaggtggggctggtgggaggtggttggatcgtgcgggtggagtgcccattgctgctggcggtggggctggtgggaggtggttggatcgtgggggtggagtgcccattgctgctggaggtggggctggtgggaggtggttggatcgtgggggtggagtgcccattgctgctggaggtggggctggtgggaggtggttggatcgtgggggtggagtgcccattgctgctggcggtggggctggtgggaggtggttggatcgtgcgggtggagtgcccattgctgctggaggtggggctggtgggaggtggttggatcgtgcgggtggagtgctcgtgaagggtttagcaccatcctctacttgggactgtatagtgagtgagttcttgtgaggcctggttgttgaaaagtgtgtggcacctgccccctctctccctttctcttgttctggccaggtaagttgtgtctgcttccccttcgcctttcgccatgattgtaagtttcctgagacctgcacagaagcagaagcagctatgcttcctgtacagcctgcagaacagtaaaccaattaaacctcttttcttataaattacccagtctcaggtgtttctttttatcttttttttttttgagacggagtttcactcttgttgcccaggctggagtgcagtggtgcaatcttggctcactgcaacctccgcctctggggttcaagtgactctcctgcctcagcctcccgagtagctgggactacgggcatctgccaccatacccggctaattttttgtagttttagtagagatggggtttcagtatgttgcccaggctggtcttgatctcctgacctcacatgatccagctgcctcggactcccaaagtgctgggattaaaggaatgagccaccgggcctggcctcaggtgtttctttacaggaatgtgagaacaggctaatacagaaaattggtactgaaaagtggggcattcgtatgaagatacctgaaaatgcggaaataactttggaactgggtaatgggcagaggttggaaaaatgtggggggctcagaagaagacaagaagatgggggaaaatttggaacttcctagagacttttaaattgttgtgacccaaatgctgatagtgatatggagagatgggcaggctgataaggtctcagatagagatgagaaacttactaggaactgaagcaaaggtcacttttgctgtgcattagcaaagaacctggcagcattgtgcccctgctctagggatctctggaactttgaacttgagagtgatgagttagggtatctggcagaggactcctgaaagtgatttctgttaaatctcgccctggcaatattaattacaaatttaccttccaggtacaaaacaaggacaagatgagattagtcactcttctgcctaccctgatatgggctacataactctttcctctactccctcttgtcagatgtttgcctcatcttatgtaaattgttggtttactgagcactaatcagagcatcactgtggacccctccctttttttcctcctgcttgccgtctcctcctaaacacccagtccccataaccctatttggatggcacagttgatgcttctgtggcttgcgtttttcccgggcccatcatcagacttctactgatggagacatttgcctcagtcactcatttttggttaactaggaatctcattaaatggatagaagtcgttgaaaatatggcttaaaacacacctcaccacatgcctgccccaagttaatgagcagagttgattactgcctgcttgcagaagtgggaaaggaggaggaaaaggaaatatacagggggacaaatttttaaacacaacttcaaaatattacccagtcatatatgtatacacacacatagaaaattacacggcagattacttacagtagcgtgagagaatttttgagtgggtgggattctttacagcaagtttttttttttttgcttctttgaattttttttactcttttaggtttttatatttataaaagttatatttactttttaaaagtgtcaaccttaatattgagattcagaaatatgattacatatagtgtgtatttgagcacagagcctgagaatggccacctggacaaatggggtcagcctttccaagtggagctcaggtctctcttaccaggcggagacagaagctccagcaggatcaccacagttctcatatgagaccaggggcacacgccgcagcggttccattggttagggatctctgtatttgaaggaagattgcgttataactccatgaggaggggtagtgatctgagggggtcttatctccggtgccatttggtctttattgtttacagggaaaaaggcagaagttacagctgggtgtggcatgacctaggccgcgtagccacattcccctcaaggctcaggtaattcaaagttccaacagcttcaagtttaaattattttaagtttgaatgatttaatttcacaaaaggtaatatatgcacattgactgaaattcaaaagcacaaaaagatatccaaggaagtacctctcccacttctaccatctctcatcttccagcactccttccagaggccttgcgctatgccggttttctcatttttccttcctgggacagtttagggatttttctacctatcattaaattcgtattttactcaaatgcaggcatacgataaacacgatcctatacttgctttttcccacatactatatcttgaagatcgttcaatgtccatgcaaagctgactgttcttttgaacagccagcgagtattccattacgtgagcgtatcatgacctatttactcagttccatacttcatgggtgtttaaattgtctgcaatcttttgctattacaaacgaaaccacaggtcattttgcacacatgcaaaaatgcaaatccatggtatatttcccaaaataaaaatcattaggtttaacagcacgaacacctttaaatttggaagatattccaattcgttcatcctagagagtataccaataccactcacaaaacttgagggtgcctgcttcccgacattcctgctagcagtgtcatcaacctttgtgatctttgttaacatatgaaaagtggtactctaattttaatttttattatgaattaagttggactttctttcgtatgttaaagtctatttgcatttctttccctgtgaactgttttttgcctgtctttctcctgagccattggtctcttcccactgacttattacatatatgtaaagggaatattggctctacattataaggaaattcgaattttgtgataggtttcaaatttttccctaggttgtctttgacttcatttgctgtttgtgcacacaattttttttttttgtaatgagagtgcgttgctcttatttttaaaatgttgactacattctggggaaagaaggctcagcagccacctgcttttttgcccgggtgggtggtccggccccgagccctcctgactctctcgccaatgcccagaggcgccgcagcgattccagggaggccgcgctctcgccccaaggcaaccagaagcccacgtgccaggagaggcatcggaaccaacaactcgggtccgttttcccgcgccagatgggattcgtttgctgtggacttccggggcggggcctgcctggagcggaagagcctgggcagtgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccaggtgggcggccccgactcggggtgcggggcccaggcctcgccgggtctttttccgcgcggcgtggggctggggtgactgttgtcggggctcttggtggggaaggactgggccggccctgggccttcatctggggccagcagcgctgtctccgcctcgcccagaagggagcggtccctgcagctgggaggggcacagcccggggagtggaggcccccgagcgcacggggcgcctcagtcgggtctgagcctcgttctgcacctggcgcggaggaggtgcccaggaaacactgactactcagtgcaagttgaaggacaatttttggaggaaagttgcagggctagctaataaaacatttttgagaggtttagttgtaatttttactgggctgaatttaagtgaataaagatgtgaagaagcctgttgtctcaaatcaatactttaaaaattctcgttaactatgtctgtgttctctgcactacctttgaatagcagagagcgtttaaggcaagaagtgtcttcgagaatcagcagcatcagttttatctatattgttgtttattttttgttgaaatgcttgctctttcaggaaattggaaagaaagggaaagaaaagccatggtaatgcagagttttcggaattgggtgctaactgacgtggccaaatgtttgcagtccatttggagggctgtgtttttatttaccatgagtcagttgaattcagtgttttctgatcactttttcttcggtacggagacgtagtgaggaatatgacaggcccggtttccagccagagacaccggtattgagcatatttataactatcccgttggcattcctcctgcctcgggctagcagcagtggtcctggcttgtctccaggggaactgaggcagagactgtagaagactgaggactgaggagcagaacagggtctaaagctagccgtaggtcactgtgggtggccctcattgtcggctccttcatttttgttagacttggaggaggtgagttcttccccatgttcagtgaagcttagttaatttatgtgtgtgtgtttttaaacttgagtgttattaaaactgccactgtgttatataaggtatttgagtatagtgttctgtcttctaaatttcactttgggattcattaacagctcgttgaaagtgttatataaatcacacatgaattgttaatgactagcttttgctgtttcacttgcatttcacttgtatgtttcacgatacatttttacagtgtatgagttttaaaaaattaccttcataagttgcatatacaaagatattacaggaatgtttgtattgcgacactgaactaaaatttaccctacgtgagatgtaagatagagatgtaacaaattgttgtcttgagatgaagatttattacatagaattatattaatatattacatagaattataataatattagataactgtttaagactattaaaataacagggcagttaccacctttttttttttttggtatgcagcaacagtatcaaagtgctctattttgggcagataaagtagcttcactctctcgtggtaagtgacaaaatgctaactggttttctgattaatcttaaaattcgttttctatttcaccttgtacctctgaccacttatgtgaatttttccctccagaagaaccccaggacatctattggttggctcagtgtctttacctgacagcacaatatcacagagccgcccatgcacttcggtcacgaaaactggacaaagtaagtgatggtatgaactttaaagctcttcagagctttaaaaaaaatgtcattagtggccgggcgcggtggcttacacctgtaatcccagcgctttggaaagccaaggcaggtggatcatgaggtcaggagctcaagaccaagatggtgaaaccccatctccgctaaaaatacaaaaattagccggacgtggtggcaggcgcctgtaatcccagctactcgggaggctgaggcagagaattacttgaacctgggaggtggaggttgcagtgagctgagttcgtgcattgcactccagcctggacaacagagcaagactctgtctcaaaaaaaaaaaaagtcattagggttttaggtgtatattccatttctgttgaaattatttaacttgatgcaatttttctttgtttttgtttttttgaggtctctctgtgtcacccaggagtgcagtgggatgatcgtggctcactataacctcagactcctgagttcaagtgatccttctgcctcagcctccctaatagctgggactacaggtgcatgccaccacacccagctaatttttaaatttttttggtagagacagagcctcactatgttgcccaggctagtcttgaactcctggtctcaagcagtcctcccgccttggtctcccaaagtgctgggattatagatgtgagtcatcacagtaggcccagtttttttttagtgaaagtgaagggaaaatgtcttatacctaatctgtcaccttctttttcccccatctcccatctagtctctaaattctgaagactgttttctaaacagctctggaatcatggatattcctcttcctccccactcgtacgtgtcaggcctttgatttttttgtctgttctgttacagcctctcttcttgtctcttttccccagtaacagtttctctcttcttatcttccctgtcacaagttcatcttgtgaactattacaggagtgagtagtctttaaaacacggatgtggttatattcccacaaagtcattcagtgacttcccattagctgcaggataaagtcagatgcatcagtaggtctgtgaggccctccttgttttctctccactctgcgtctaatccaccaccatcaatacctggagcacgtgctccagtcacgtggtgctgctgtgagctccttggacacccagcagttattcacactcagggcctgaagtggagctgctgcgatctccttggacgcccagcagttattcacactcagtgcctgaagtggagctgctgtgagctcctcggacgcccagcagttattcacactgagggcctgaagtggagctgctgcgatctcctcggacgcccagcagttattcacactcagtgcctgaagtggagctgctgtgagctcctcggacgcccagcagttattcacactcagggcctgaagtggagctgctgcgatctcctcggatgcccagcagttattcacactcagtgcctgaagtggagctgctgcgagctcctcggacgcccagcagttattcacactcagggcctgaagtggagctgctgcgagctcctcggacgcccagcagttattcacactcagggcctgaagtggagctgctgcgatctcctcggacgcccagcagttattcacactcagtgcctgaagtggagctgctgcgatctccttggacccccagcagttattcacactcagtgcttgaagagctacccagtgctccactcctctgcctgaccacttactcgctgcctcacttactcgctctcctgcagatgtttacttctccacctggttgatgctttctgttgccccgtttcgtcatgcttacctgttgtgcttagttcacatctcccctactgtaacctcctggggcagggccttactgcttttgaatccttggtgcctagtaaacagtaggttcataataaatatggtttaacaggactggattttttttttaactgcaagagtaaaaggagaaattatgaaattagttctattttatgcttatggctttctttgaaagtgaagatacatattattttgaccactacttaaacaaattaatttctttcctagttgtatgaagcatgtcgttaccttgcagctaggtgccatgtaagtatgctcataatttcatttttatttggttgaataaaatgagtgttatgcatctcttaaatatgtgtgagaattttagtgatggagcttagcaggttagtaaagtatttcatgaggaagtgttcctttccttagtcatgtttgctataaaatactgattcttcgtttaccacatgctgacatgcatgaagaaaattctactttagacatttcacatttaaataatgggcatagtatatgttatcctttaaaaattcggatcatgtgtttcgtgttagaagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcagtaagtagtactgtgagcacagctcagtaacggcggcgagaattgccctcattacgtggcagaaacacattatcttcttttacttattactatattaaaacaattgtggttgccaatttatttaatttgcccaccaaaaccaaaaaagattctgagacatttctgagcccttagttgcaagctgtaattgtatccgcagatgcctgcatccaaaataggctggcttgaaacttccttctcatatttgatgccttaagctactccctaaaagtggaataatttttcttctcctttctgtgtttcagcagtgttttggacctacaccaagaaactttgattagcgtacattgtttctttccaggaaatggttttgtgttctgtttgcttcaaagtacattgctatgtaattgtgtatatttcagtttgtatacttcatatctccatgaaattgcacattccttgctggcagacatcatatagtaacttattaagtgacatttacagatcactaatctggatttaaaaaaaaaaataaaaacttattgaggtataatttatatgccatgcagttcccccatttaaactgtatggtttgattccttttagtgtattcacagagctttgcaaacctcaccatggtcaattttagaatatttttattattcagaaagaatccctgtaagccttacctgacctaccaatttctctttcttcccacatcttttttttttaaattaagacagggtctttgctttgttgtccaggctggagtgcagtggcacaatcacagctcactgcagcctcaacctcccaagctcaagtgattctcccacctcagcctcccgagtagctgggactacaggcgcccgccaccatgcccggctaattttttgctattttagtagagacggggtttcaccatgttagccaggatggtctcgatctcctgacctcgtggtttgcccacctcggcctcccaaagtgctgggattacaggtgtgagccactgtgcccggcacagttggctaaattttttaaaaaatgttttgtagagacagggtctcactgtgttgcccaggatggtctcaaactcctgggctcaagtgatcctcctgccttagtttcccaaagtgttgggattacagtcatgagccactgcacctggcccatttatttatatttttggtagaagtttattacttgacttttcaccttagatagttatttttaagcataaaagaatattacacattctaggtttttgtttttgtttttttttctggccactcattaatgtatgtgttgggaagcagattcttctgttaagaaatgcatttatgaaagtgtgtggtacagtcattattttgggacctcttatccattaacttatttgctatgaaatgtgtgatttatttgcaacgcattattatttattttgtgaaattacatttttaaaaaacaactcctaggatattgcttagttcgaagactctcataattcattattttttctaaaattttactttatgaatcttcttcatatccttaatgatactagctgcctgttgctggatcatctttaaattcagttatgtgttcgaggtccagagtctagaatgtgcatcagatttccacatcttcgtgtttatggtagtcgtgagatggctgttgaacgccttactatgtgctagcaccacagagatggtagcatctctagccctcacagacttctataagttagatagtaaagagttctataagttagatagtgtttttatctttttacagatgaggataggaaatggaggccaagagaggttcaatcacttgtccgaggttacaagtaattggcagagctggggtttgaactcaggtctgtgctgcctcagcaggccattgtgctgactgctgtgaccactctgctgcattgctgccagtttctgctcattaagatccttttgaggggtgtctgcctatcacactgtcaatcttggagttttatacacatgcacacacactctgccatctctaaatcattgcactgttttggacaaaacaggtaatgaacctagtagccgtgacatgtacttttgttataaagatgtgttggaacagagcagttgaagcccagggaaggtgaattgaagaagctttgctgtgcattttttgtgtgtttttatttatgccttgacagttgtgattgactaaatccttttaaatgcaataaaaacttctcagcattcaaatacacaattctctatcaaaagttaagtttaagggccaggcatggttgctcatgcctgtaatctcagcacttcgggaggccaaagtgggaggatcacttgaggccaggagtttgagagcagcctaggcaacatagcaagattgtctgtacaaaaaatttaaaaaattaactgtttgtggtattgtgcacctgtaatcctagctactcaggaggctgaggcaggagggtcatttgagatcataggagttcaaggctgcagtgagctatgatcgcaccactgaactccagcctgggagacagagtgagactctgcctctaaggagaaaaaaaaaaagttaagtttaaaagtactgacttaatatgtgactcatcatttttccaacagataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaaggtttggaaactcaggcttttttgttttatgtttagcaaaattaatattgtttggattttttgcctctgaaatcttctaagtcaacaacaggccacatacaggtttaaatagacctactcactttcttaatgtcttcaaatgtaaagcacgttgcagaatgcagtattgtacggtgccttgtgctgtccgaatctagggattgtgataggaagaggccatctttttgagaagtgattgagatagtataaaccaggatttcagtatctcatgcagtgattctcaaccgtgttgctctttacatccttgggaagacagagaaacatccatgtccagttcccaactccagagcagatgctttaaagctcccaggtgatcctaatgtaccacaggcactgagaatcagtccaagtatgttggcagtggtgtgaggtgcgtcaacaagggaaacagaaaatagagtggttggattaatgggattctaacatattttagcctagtgcagtggttctcaaccaaccagagtgattttgccgccccctgccccgggaacagttggcaatgtctggagatgttgtttgtcacagcttaggggcagggagggaggttgagaggttgctgctggtatctagtggttagtggccagaggtcctgcttagcacctgcagtacacaggctcccctgttcccagcagagcaagatccacgcagtcaggagtgcggaggctggtggttcttaggtgacaagagccacctggggacctgcctcagccctgaaagagtagcctccacccaccagatgattcccgtcttcaggcctggagccactgtgtcagcttctgttgcacattttgatcttatgttctcttttgagtttgatttacttagaccaagaactgtagaatcatatttttagttgttggctttttcccctctataaatattatgaggatattcttttttttctcaccatttttaagaaaaagaacttcttgaatcactaccccttagcaagctgtgtaatgaagaacaggaattgctgcgttttctatttgagaacaaattgaaaaaagtaagtaaaaccaaagagttagcacttgctttatgtaaatatcttattccataaaatttggcatctagtcttatattaagttttcaaaattaaaactttttaaatttagcacatttttaagaatagagcgtttaagatacataagattccaaaaaaaaaaagctttcaaaaatacctttttcctctgaaagactccttatactaaaagattgaattaccaagtaaatgtaaatggaatggtgttgcatggaaatgaagatttttttgttatgcttcctgaatgtttactttgagaaatacgtcccgctgtggaattctgttctaaaattgagaagggaattaaacttactgagaggagtacttataaaacctaaagttataagttttcagaggctctcacatttgttcttgtaaatgttttaaccacttgggccaaacacaaattgaatccacattttattttgtttttgctcattgagtttatgtttacatttctatgtgtttcagtataataagcctagtgaaacggtcatccctgaatctgtagatggcttgcaagagaatctggatgtggtagtgtctttagctgagagacattattataactgtgattttaaaatgtgctacaagcttacttctgtgtaagtatatccatccatttttctgtaggaacatggagttcactccatcttacctaggtgattcacggacgtgctctctgaataatcttgaactagatgataatttaagttatctttaccaattgtagagcactgaacagggtgctgtcttaaaagagcaatttacagacatgaatttgtgcatatttgtagatttattacattaacttgggagggatatacatgttgctcttactgatcttgataatttgcaagtttgaaaattccattttggcacattgttttgtaaaatttattctcaattatgagactcacactgtagatactaggtgtttaatatgctgcacgcagtagctaagccatctcccacatgtatcagttttccagtgtacctaatttaaactttagctaaatgacatatgctattttttgtagatcttggttcggtttaaaatccttgaaattacaaaaattttaattggcaaatacacataacctatttattagtttggtgcaaaagtaattgcagtttttgctgttgaacgtagtggtaaaactgcagttatttttgcaccaacctaataggatttcctgttggttttgattcttttaaataagcggcctacttattttatgtattacaattctgttgacttaaagtaaatgtatgtgataatgtttatttttattcctttcaaataaaccagaattttttctttcatttgtaacttaattatggccttaactgaatcaacctgaagataatggagtgaagaaagtgaagtgttacaacccacagcatcatatgtgataccataatgactgtctacacatagccgatcgtcgtgagtgctgtcacctgctggtttgggggtagtaatgtgtcgctttaactttcagagtaatggagaaagatcctttccatgcaagttgtttacctgtacatatagggacgcttgtagagctgaataaagccaatggtaagacttttttttaaattaaagtaattcttagacataaaacaaatcttttctgtaacttgaaattttgtctctgaaattctggatagttgagattgcaggtaacaacataatggaaccctactataaaagtaacaactggggaggaaatgtttaggaaagtagcaaatggccaattttgttttcccatcagaacaattagttctttatcactgcttcctactaccttttctcaaatatcatttatgtttcaaggtttgttagctttaaattgttgggtgtcagttctgcctcccccccccttttttttttttgtaaattccactggaaatctgatatggtaagagttgataactacttagaaattggaaaggagcagattgtttgctcatgttttccgtatttttaacatttgacatttagttgtgtttggggatgcatttgtccttaaatttttctaaactgaatggtgagctctgtcaggaaggaaaaccctcaccgaatccctgctgctcagagtgtggttcgtggaccagcaacatcgcatttgtggaagctggttggaaatgcagcatctccagctgctctggtctactgaatccaagtctgcatgcaggaaacatcatcttgaaatgccaggatttacacatttctcaagattaaatagtatcattgatctgataaacttgaaagtttgttcagccaaattggttgtgggtgattatgatggtccataatgggcccttggtgtgacaggcatgagcttctaagagaggtgaggtgctttgctgtatcctctgcagtattcgggaagtgctgtcttagggggtgtctgttcccaccttgcccacagtgtgtccttcatctaactctccagttagagagttaattttttatctagaaggaaagacaagtatgaaatcattgctgtaagagcagaattatatgattgtgaagagttgtaatgaaatcatgtcttaaattacatgtgatacgaacaattgttctttttctgctttttcctgaacagaacttttctatctttctcataaactggtggatttatatcctagtaatcctgtaagtaatataacttttagtcttagtttttttttttttacctgtactttaagaaaatgcttaactcgtatttagacaatagcttaagttcaagcaaatgatgttttattaaagtgttgcaacagaatctcctagtgtttattgtacttacaaaagcagcattaacttttcaacccatgaaggtattttttaattataccaaagcaaaaaggtttttaaacccttttttctgattatagaagttatacatgcttattttaaaatacttagcgtatagcaatataaaatactgaccatgacagtcacgcctccctttcctaagaaatgtggataattgtttggcagctttctcacattgcacatgtaagacaacctgttgaattgtgtactgattccaaactgtcatggatcggaatggagaactaggaatggaaaatggaatcagggactgcgtctttaaggacaaaatcaggaatcagggtgtaagactcagacgacaagaatttgcaccctatcccagtgtgaaaccagagcaagagaaaaccagctaaatagtcagaactcggacagagagcaaggaagagccagggtcaggctgggggagatgagcagtgcaggggagtcaggactcacaggctggtttttgaaacagggactcctcaggggccttgtcttgtgtagacgtctccttgagaaagagccatggagtgtctgccctcttctcttggaccttagtagactgtattagagaaatgtctaacttaactagaatatgtgataaggaacatgtagtataccctctgtctaccctaatttgttgcagattccaattagatattccaattccaatctttgtttatggtaaattttgaactttttaggtgtcttggtttgcagtgggatgttactatctcatggtcggtcataaaaatgaacatgccagaagatatctcaggtatgaatttatttttttcctctctagttaacctgtagaattgatgtcttgctcataagctttcaagtagtaattagtgagtactttaaaagcaatgtgaaagaataaatgtttttttttttcttcctttcttttctttctctctttctttcttgccttttcttttccttctcacctcccctcccctctctctcgagggttctcactctgttgcccagactagagtgcagtggtgcaataatagctcacctcaaactcaaatgatcctcttgctcagcctcccgagtagctgggactacaggcaccaccatgcctagctgatttaaacatttttttttttttttagtagagacgaatctcactgtgttgcctaggctggtcttgaactcctggcctcaagcagtcctcttgcttcggcctccgaaagtgttgagatgacaggcatgagccaccatgcctggctgaataaatgttttcttcaagtggtttgttctttataagatgccatggggagagagagaaaaaaaaaatcagtgatgtagaccctattctcagggaacctacatattttatttattaatgagaataaatggccaggcatggtggctcacacctgttatgccagcactttgggaggtcaatgcaggtggatcacctgaggtcaggagttcaagaccagcctgactaacatggtgaaactctgtctactaaaaatacaaaaaattagccagatatagtagtgggcatctgcatcccagctactcgggaggctgagacaggagaatcgcttgaacctggaaagtggaggttgcagtgagctgatatcgcaccattgcactccagtctgggtgacaagagcaaaactctgtctcaaaaaaataataataataattaataaatgagaataaatatgaaacaatagagaataatgtagtttgaaagtttctctctttcgcttacagagatcctgttaaccttttacttttaggatttcttttattaatagttgtgaaattacacaaaactttatgtaaaattggggtcactaaatgtgactataaaacagaattcttagcagggtgaactgattcatgtaatgatttgctgtggttttaacttaaggaaagccatgcagcctagtgaagctatttaaccagtattattcaagtttagaaaaatgtcaagtatgtgaagaattaattacttaaactctgtaaatgttctaatttctgtggtttcttccgtgcaaataaaacagaattggtctctaacggaaacagcataaactttggagtcaaatttgaattctaatccaagttctgtgacttaccaactgaaattccttgggaaagttaatttctcctgctctctctttctttaaaaatggggatgtcagccaggcgtggtggctcacgcctgtaatcccaacactttgggaggccgagacaggcagattaccttaggtcaggagttcgagaccagcctggccaacatggtgaaagtctgtctctactaaaaataaaaaaatcagctggacatggtggcatgcacctgtaatccccgctacttgggaggctgagggaggagaattgtttgagtccaggaggtggaggttgtagtgagctgagattgcactactgcactccagcctcgccgacagagtgagactctgtctcaaaaaaaataaaagggagtgggggtgggggagatgtcatactcatatagcaggattgttaggaagactgatgccacgaaagtaccctgtactaggaagaaactagaatgttccctggttggttgtatgttcagcattttagaagaacttctacatagaaagatgattagtattgtaaaagttattttgagctatgctgctttgatctagcgtgcaattcagtgatggactcttatcagtggtccccaacatttttggcaccagggaccattttgtagaagccccccctcccagggtggggggactggtttcttgatgattcaagcgcattacatttatcgtgtgcttttttctattattattacattgtagcatataatgaaataattatacaactcactataatgaagaatcagtgggagccctgagcttgttttcctgcaactagatggtcccatctgggagagatgggagacagcgacaggtcatcaggcattagattctcgtaaggagtgcgccacctagatccctcacatgtgcagttaacaatagggtttgcgcacttacgagaacctaatgcctctgatctgacaggaggcagagctcaggcggaaatgcaagtgaaggggagtggctgtaaatacagattaagcttttttttttttcaaatggcaagttctttcttgacatatgaagctttactcacctgcctgccactcacctcctgctgtgccgcctggttcctaataggccagggactgataccagtctgtggcccaggggttgggacccctgctctacatgaaacaggtaacatttggataaaagaaaacttaaaatacaaggaagtagggtatcaccccctatgtcttccacgttttgtgatatgttctctttattccttgtgggttaattatacagtgttcactgtatacaattattcactgatatatatgagtccagtccctgtaaccagggtatatctgttgaccatcatctataggatatcgcctaatccctcaagccttggtatacctgtctttaaaatataaatgaatttatcttgcaagttattaggatgagaggatgtatctactaggttacaaaatggagctcctggattaagtaatatctgtaagttctatttagaatgctaatgggttttgctacagtgcataaaaagctgtggatctcctcaaatttcttaaaattttgctatactattaaacagttttagttcaaatgaatcaacacaaatgttacattagtgtttaatgtggtgacagcttgtttactaaatggatgttaatgtttttgaggccatctccttatataaaattaacaattcaagaataaatactagctgggcacagtggctcgtgcctgtaatctcagtgactcaagagcctgaggcagaaggattacttgagcccaggattttgaggctgcagtgagctatgatcataccactgcattccagcctccagcgacagagcaaaactctgtctctaaaaataaaaaataataaataggctgggcgcagtggctcacgcctgtaatcccagcactttgggaggccaaggtgggtggagcacctgaggtcaggagttcaagaccagcctgaccgacatggtgaaaccccatctctactgtgaatacaaaattagccgggcatggtggcgggtgcctgtaatcccagctactcgggaggttgaggtaggagaattgcttggtatctggaggcggaggctgcagagagccgagatcgcaccactgcactccagcctgagcgacaaagtgagactttgtctcaaaaaaaaaaaaaaaagaataaatactatatgacttaaattaactcttttgttttagcaaagccacaacacttgagaaaacctatggacctgcatggatagcctatggacattcatttgcggtggagagtgagcacgaccaagcgatggctgcttacttcacagcagcacagctgatgaaagggtacggcagagcaaactcatcaaactccatgaagggatgtttttcctaatagaaatgaaatttctattactattactgctatttggttgctaaactaaacacaaacattttacttgccttttaatctagttgcttgtgattgtaaaataactatgaaagtggaggggagagaagctggtgtatgcatttgcctagcagttgattccaaccagtgcaagaagcaaccaggaaattaggccagtggaggagaggagttctggaagcccttcctcacatgctcatgcaagaataaaaatattcacgagcaaaattattatatcttatctattaccaaaaggtatttgatgtggcttagtggtaggtgcaggactgtatttgccagtattctagatttatatcaatattaaatgtattgaaactaagaatgtgttactttgaggagtagagtattgctgttcacattgactgtttggtctcaccatcggttacaacttacagggttggtttgtgtggactgcttctattgactgatgactgcatccctgcctggagaggtagtgggagtgcagtggtccagaggcctggtctggagtcatacctcctggactcttcctggctcttccactcccagccatgtgacgttgggcaagttttttagcctcctgagaaataggaataatagcaaaatttactcactggcttattgtgagaagtaattgagataataccaattaaagactttgaagagtgtcttacacatagaaagcactcagtgaaagttagctacttgtgtttatttacttgtatgcaggggtggaatcatatatttatctgtattgaatgtcatcctgttaggtttggtctctttgcaaactgttaggctctttttgtcactcagttctgcgtttaaattagtacccacctcagtcagtagtcatagtaacttggtaagtatcatagctccttagctgtattagtcagtagggctgccataacaaaataccacagactgggtgacttaaaggacatttattttttcatagttgtggaggttgagaagtccaagatcagggtgctggccagtgcagttcctattgaggagtctcttcctggtttgtagataactgccttcctgctgtgtcctcacatggcagagagagctctggtgtctcttcctcttgtaaaaacactagccctattggatgagaaccttacacgaaccctattggataaaagccttacactagccctgttggataagagccctacactagccctgttggataagagccctacactagccctgttggataagagccctacactaaccctgttggataagagccttacactagccctgttggataagagccctacactaaccctattggataagagccttacactagccctgttggataagagccctacactagccctgttggataagagccctacactagccctgttggataagagccctacactagccctgttggataagagccctacactagccctgttggataagagccctacactagccctgttggataagagccttacactagccctgttggaaaggagccttacactagccctgttggataagagctttacactagccctgttgggtaaaagccatactcttaggacttcatgtaacctttattatcttttcataggccctatcttcaagtacaggcacagtaggggttagggatttaatgtatgaatttggggggcagaggggacacaaacagtccatagcactaatatattactagaaaataaccttccagagtagagttgcacacccagttatggatccacctaaatggtcctcatactcagtccaggtctctccatcctgttcaccaagatgagtgagaccttttccagttctcttctgaagctcagctccagtatctgcatatttcccctatgtatcaatatgataatttgttaccaaaaaaaaaatctcaataattcactatgagttggtttttatgagcatatgctacagtctggtaatttttatttgatattttgggttctcagaaacagaatagttattagttagttcctagctgggaatcagaatcaatgataattaatgacacaataccttcagtgtttccaaatctaacaaactttgtcattaaattctcacattaagctaggtgtggtagctcacacctgtaatcccagcactttgggaggctgaggtgggaggattgcttgaggccaggagtttgatactagccctggcaacatagtgagaccttatctttacaaaaaaaaaatttaaaattagctgggtttgatggtgcctgcctgtaatcccagctatgcgggaaactgaggcaggatggtcactgtgccaccacaatccagcctgggtgaccagttgagatacatctcaaaaacctcatgatagctcatcaagataagcattatttttctttcaagtttacttatctgtcagagcagctctgcattttcttaacttgtctgtgtttggataaatgtttgaaattggatgaatatttttacgtgtcctttatgatttcttttttgagtcattggttatttaagaatatgttgacatttaacttccacatatttaagaatttcccaaattttcttcttttgttgttttttaacttaattccattgtagttagagaacatacttcgtgtgattttagtccttttaaatttattgaggctggccgggcgcagtggctcacacctgtaatcccagcactttgggaggccagaggggtgtggatcacttgaggtcaggagttcaagaccagcctggccaatatggtgaaaccccatctctactaaaaatacaaaaattagccgggtgtggtggctcacgcctgtagtcccagctactcgggaggctgaggcaggagaagctcttgaacccagaggcagaggttccaatgagctgagatcgcaccactgcactccagcctgggcgacagagtgagactccatctcaaaaaaaaaaaaaagaaaaaaattattgaggcttttttatgagccattctatagattgttccagattatttgagaattctgctcttgttgggtgaagtgttccatagatacctgttacatctgattttatagtgttgttgaagtcttctctttcctcattgatcttctacttatttattctctgcattattgcaagtgaggtattaaagtctccagattttattgttgaattgtgtatttctccctccaattccggcacatttcacttcatatattctgagtctctgttgttaggtgtgtacatgtttataattgttgtattttcttgatggattgagccttttatcattataaaatatcactaattatctctaataatacttttttttataaagtctgtttcatctgatgttactgtaggcacaccagctctcttttgttactgtttatatggtgtggtttttttcattcttttaatttcaacttgtgttttgaatctaaagcatgtctcttgttgacaacatacagttagatccatttatgtttaattactaacaagataggatttatgtctggcgttttgttctttattgtctatacatcacatcttttgttcctgtatttcttcttttgtgttgagtaaatattttataatgtcccattttaatcccctttttttattatactatatcttttgagttattttcttaggttggttatctttaggattataattagcaccttaatttaaaacgacctactttgaattaataccaatttaattttaatagtacgcccaaaccttactccgatatagctgtttcctcttgcctccttgtgctgttagtgtcatatagaatacatcttacacattataagtccatcagcacagatctgttattattatttattctgttgtcttttaaatcagatagaagagttaaaaacaagcacattttatactgtctcataattaccaatgtagctatttttatcagactctcatttcttcgtgttgtaaaccaaaaataaaatttgaagaccctccccaaccatctaaatgggcttcctcctctaggccagggccgtctaaatttaacctgaaagactggttcaggccatgatgggaagtgggggtccaacactcctctttacgccctccagcattaacatcaaatggaccttcagtctgataagaagaaacacttaccatctatcctctctgaagcctgctacctggaggcttcatctgcatgataaaatttggtctctgcaacctcttatcataacccagacattgcttactattgataataactctttcaaccaatcagaaaaatcttaaatctacctgttacctggaagcctgcacttcgagttcttagagtttgactcttctgcaacaatgtggatttgaattcctatgtagtatccttctgttttagcataaaggactccctttagtatttcttactgggcagatgtactaatgacagattttctcaattatacattgttattatttatgtaattttgtttttcaaagaagctgtgaggaaagaaggtgtatatacttatatcatttgttatattaaccctgttatttaccattttcagttctctttgttcctgtgggttcaagttaacatccagtgttactttcctactgtaatacagctttgctgtcacccgcttcctattacactgttactggtaaaccttacatttctgtatatgataggcccaacaatataattgcacattgagtatccctaatctgaaaatccaaagttcaaaatgttccagaagcccaaactttttgagcactgtcatgacactcaaaaagaattgctcactggagtattttggattttcagaatagggatgcataaattccaaaattaaaaaaaaaaaacctgaaatcccagacacttctggtctcaagcatttctgatgaagaatactcaacctgtacatagagtctcactctcttgcccaggctggagtgcagtggcaccatcacagctcactgcattctcaaactcctgggctcaagggatccttccgcctcagcctctcaagtgtctgggactacaagcccataccaccacgcttggctaattttttattactttttagagatggggtctcactgtgtgtcataaactcctgggctcaagcattcctttcaccttagcctcccagagtactgggattacaggtatgagcccagggggctcttttaggagctaccagacaggtcaaatagcagcagttccctgtggggtgtttgaggaactctaaattaattctgctttctccaatggctgctaggctaatggctttacaacggctgttgttatgagactgcttgtttttaaggttaatgcaaagctagggaaagggagatgggaataagacaagttaaagcagcacaaagttgttcttactgagatttagccatcttttcttgaatatacactcctcagattgttttaagagcttggttaccttccaaagttctgaaaaaattggttttgataatttttgccagtgttgttgttgcttctatggatgaatagatttttggagtccttatgctgccattttgaaagtacttctaccaggtgtaaatatttttaaagaatttgtcatgaccttctgtagaggatataatcttaatttgagttatgactctagattagaaccaaagcacacaccaagcaatcagtatttattgatgttctgagatcatcatcaaggaaagattgtcttattacacttgctttaatgcaatcactgatcccaatcgtgtgaacagatgaaaattcaattaaaaagtagttctgactctgcctagaactgtctcagaaggtgggaaaattgaatcaatacacagggcattattcataactcttctgcatagaactgattataatgggaattcacagaagggagagcatttatgttagaaaagtcagaggtagcttcataaagggaagtagaagttgaacccaatcttgaaggataaatggtggtgagtaaataagaggaagaccagtgtcggctggggcatgacattagcatcaaggaggaagacagcaccacagagacctgcccttttgctttagagagtttttgtttttttactgtggaataataatgaaaattaaaggtaaataagttgcagatagattctagaagtggcagctgattagtccaaagcccattaggcattcattaaatatttgtaaattaagagaaaaaagtaaatgctgtgttttggctacctttaaattattttgcagataggatttgaagttgacagattaatttctgctaaatcacagtttttggtgttgaatatgtgaaattttccaattttttaggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagagtaagtactggaagaccagaaacccttctgttaactagtgattgtaaatacagtaggtgatcactagagttcactgacaaaagcgactcttcagtagatttgtacttttaaatgttctattttaggagaaggagatagaaaaaaaagagagaaactgttatcttggatttccttaaaaattctaaacccaggttttggtctttttttgatctgagctaccacttcttttcttacatgattggacagttcagattacacataccccacagtgtggctgggggcactgtggaatccttagttatctctgtgttgataaggagttgaatttacgtatttgagaagaatttgacatggtttttgaaacaaaagtgttttctatttagttactagtaagtcagaaaatttaattcctggtcagtgtaggctttactgtactctagaatatttgtagaataagtgatttggtgttatactcaaagagaaaaatgtatgtaatcctttgcatttcatgatatacaaattttaaaatggtaaattagtttcagttttttttggtttttgtttttgtttttttgagatggagtctcgctgtgttgcccaggctagagtgcagtggcgcattttcagctcactgcattctctgcctcccaggttcaagcgattctcctgcctcagcctcctgagtagctgggattacagatgcccaccaccacgcccggctaatttttgtatttttagtagagacagggtttcaccatgttggtcaggctggtctcgaactcctgacctggtgatccgcctgcctcagcctcccaaagtgctgggattacaggtgtgagcctccacgctcggctgtaaattagtattaatactactacagtgtcatttatggcatgtatgtgttctaaaaaatgggttatctaggtattttttaaaagtttgaagctttaaaataaatagtaatcttttaatataatacagtaatcatcagtatttgcgaatttgcctactcattaaaatttatttgtaaccgccaaatcagttcctgaggtgctttctgagccattggcagacatgcccagggctgggagaaagctgggtctcctggcacacacacttccagctggagtctaagaaggcaacgctctgccttttttcccagttcaactataaaccagtgtacttcttgtggtctatttagtgccacagttttcacatttttgtgctttttgttgatgatttcactgttttgaaataatccccaagcttagtgaaatgctatctagtgttaattgtgatacacttttgtgttacagaggaaacacatgtattagagaagcttcattcaagcaggcatcagtatttatagtgctgctggccctgacttcaatattgatgaatcaacaatatgtatcaaataagacgtctttaaatagaaacacacataaaacaaggttacgcattgatcaattagagaaaatgtgaccagagaattgcaggaatctaactgtatttcccctggcagccgcggttcaatatttgctaactcagtgtacacagtgactttatagaacataaatactgtggttgggtgcggtggctcccgtctgtaatcccagcactttgggaggccgagatgggcatattgcttgaggccaggagtttgagaccagcatgtgcaacatggcgaaaccccatctctactaaaaatacagaaattagccagggatggtgttgtacacctgtaatcccagctgtgtcaggaggctgaggcacaagaatcacttaaacccgggaggcagaggctgcagtgagctgagatcgcaccactgcactccagcctaggtaacagagtgagactcttaaaaaaaaaaaaaaaaaaaaggaatataaatactgtatctcccaaaatcttgaaatcttgaactcttgatattaatgccgtaaaattaatcatttgtgacttaactttgaatttttataattatttccagcagtttaccccattgcattttagtactactagaaaggtaatcaaaaatttttttaaagtttatatttgctaatttcgaataatctgcaaccttttttcctttcattttagatggaaaacagccgaaaaatggtttcttgatgctttggaaaaaattaaagcaattgggaacgaggtattctttgtagtacctgtaaatatacacatatacacccctgagtgtttactgttaaatgaggaaaacaacacagaaatctcttgccttcgaagatagtaacctgatattttcataacaagcggctgttaatgtttgcattgtcagttaactgttttaccacatggtaagaaatgagttttttccctaagagggcaagtgttggcgtttgcttcttaaatgggctctagctttgaaacgtgagaggcatcagaatagattgggtgattatttgaagctaggaatagtcattgggtcacggaaacaattgggcactgtagcgtcagatgtaatattcctctagaacttcagagagcttctttgactgaagggtaaataaagtatagcagcaggtcccacttctgaaaggatagggatgggataggtattactgaaattcacaccttttgttgctgttactgcatactgagtgtgtatttgggcctttccattttaaaatatttgactgcttctgttgtatgaacgatcccgtgaattggtgcttatgagttaacctaacaattatcaaggatgtgtatatactgatattacttaaaagtagtaacagttttagataccataaacttgcatagtaagagatttgcatgatgctcttctgtttcattcgtgcctgttttgtttcattctattctgattttcacttctcagcttcctgctgttactgtttgtgcacacctgcccacagttttcttctcccttggctgttagctctctctgctgttacagacacagctttgcctccctgccaagcgatctgcctgtccccatagacacagctttgtttactttggtctctcatgtcatctgaacttataaacactatttctgtgtttgcacatgcgtgtatataaagcaggtgcctctgtcgcatagtcttgggtagttctggataatccaagtgttttgttaataggggattgccacttgccaccttgtcagttttctaagaagtgactgccttatgccccagacgggctcagcagcatcagcatcacctagaagcctgctagaagtgcagaatctcagaccaactgaatcaaaatctgcagttttagcgtgatgcccaggggattatcacgcacagaaaagttttgagaagcactttcctaaaccatacttaagttgagcctgtattctttgatgattaaggggcactaaatttagagtcttacagaaacttaatggttttaagtatgaaagcacaacactattgaaatgtcaaaatgctcattaaaaagttatacgaagagggggaaaatattgactttattagaaactgcagcaaatgtcaaagagaaacagtcatgcctaagagtcattaaatgatttgtttttcattcacatgggctgtgcctcctagaactggtctcaatagagttagagaatctgtggctcaggtctgttcattcatttagttgacatatatttaatgagtgtcagccatgccataggctctgagctaggccttgggatgcaaaggggaatgagtttactatttcctgacctcagatcaactggcgaatgtaagtacgtaaattgacagtgaaaatacggtgcaattgaggaactaaaggtgcccacagagaaaggcagttcacccagaaatgagccttttgcatacacctcagtcctgaaagtcatcagacatcagctaggcaaaaattagggcaagggtattccagtgtttgcaaaaattggagctaattcattatggcttggattttgagttcacagagaatgtcaaggagtgggtcaggagggttaagtgtggatcactaaaggcccagaatgaaagagtttgtgccttatcctgaggagaatgggaaaacaaaagggatttaagaaggaaacaacccggtcagacttttatgattggggcccagatttgactctgttaatgaggaaggtgaggactaaataggttggagttatgcctagcaattagaaggaaccagccctggtgtgcctcatggaagggtcagagggggtgggggtgccattcactgactggaggggcactcagaagcagtgaggtcaggggctgggatggccagggagagatgggtgtggtgtgtggtgcactaaacttaaagtgcttgtaacatttacaagcagaagtatttagcaggcagatggatagagaggtctggtgtttgagggaaagctctgagttgcagatactcatttgaactccagcagggataggctcttggataaacttgtcctaatgataacagagtcctcaggaagtctcctagtaggaaagaaagggagatagataaaacagcagttaccctggccttgtggtgtgctggcggcacacactgggagagagcccagcttgcaaggcgtgaaataattcagtgcaaacaaatcaggctgaacagtgacatatataactcgtgggcttgatgttgctatgttttaggtaacagttgacaaatgggaacctttgttgaacaacttggggcatgtctgcagaaaacttaagtaagtgaagtagagcattttcagaaatatactttgtgtctcaaagtttacttaattttgaatactttgtcatattcttatttcatgagatcaaccagctttcttgtacttggctgctcagataaaatcagcatcaaatcagtttttattatttatctgtgttggtgtaattttattttagaaacacattgagaattttacttttttatatgaaaatttagtgttcaaaattaattcagaagaattaggacagtaggatataattaaaatcctatccatagtctgttttctgctagaggttttgtggtgtgataaacaggcgacagttgaaaaatgggttttttggttaaatatgtctgggcaattttaggttattcaagatttaacaagtatttctattgcaggatttctttgagtctttactatgtattacgaacttatagcattttccaaagtttaattgagcataaaacatttttttcacaaaagactttacaagtcaagtattccagagaactttaaggagcacttttctaagtaaatcttttggaccttaaagcgatactccttgactgcttttatctacccctgatatgggacactgactgtcacctaagagggtggtgtgtggtaagggcacagccaggaggcatggattaggttctggttgcagtgtcccactgaacatcaaaaggaatacagcagacatccctgcaggagtgcccttggccggcggagggagtgggcctggaagatgcatttagagggcatattgagatgcatgagagtaggtgtggagaacattcaccagtctagactgctgttctcattgagacagcgtttcttgggtgttgatatggatggttgctcatcttagacttaggaatttagtgcttttactgtagccaataattgtgttctctcccacagaaagtatgctgaggccttggattaccaccgtcaggcactggtgttgattcctcagaacgcatccacctactctgctattggatatatccacagtctgatgggcaactttgaaaatgctgtggactacttccacacagtatgtcttttctttgtacctaattttaaatctggttaacattgaccacttccttttttgaaaatattttttctaggtaatattgacttactattttaatattctttaggcaaccttacgtgttattcttttctttgcagagaaaagcatgtgggtgttgtacagtattcatcaaattagaaacaaacatgaatcctgtccttagtgtttgcagtgaggtgcgcaggtgcccagtggcactcaccagtgatctgagtgctgagcacggggttatctgtccacagtagcccctttgggaactcgcagtctttctgttcatgactgtccccttagatcacattagtagatgaacaaaacagtctctgcagtcatcacaaggaaagaacctttcattaatccatgtaccatattccatcaaatttaagacaccatgagtaagcaggatgaccacaaagaaaaaagtgctgccaattaaactttaacataattttttcccggcacttaatttttttgtacttagagaaaatattcttgaacatatttaggcagatttgtattactctagtacatacatagaaatgtacatataagtgaaataaatggttacaatattcagcccagagggccagtatctgtgttttctcaaaatagtgccctggtgctagcacacacgcccagttcctgactctgggtttcctcccagccacagacacctgctttccaactctctctctctctcgtccctctcagtctgctaaagtgtcaacagaaggtttttagaaaaccacaattcccgcatctgtttaagtgttcctcgcatggtttgtgatctagtctgtgctgccaacataaccaccaagttcacgcttctcaggcaggttacccatatcacagtggtggctggtggatggcaataataggaaaccacaggtaaaagggaagcaatgtttgaatttgagaaaatgtgggtcttagaatcagtgaactaatggtatttggagaaagagataaaatatgagaaaatttatcaaagataaactcatgagcgcttcgtaactgattttcaagagttcattagagattttgaggttagatgaagtcatgaaggtaccatgatggtcaccagaacactgagtttgtcagaagtttggactaagcacattttctagtcctgtatgatcttttaaatatgtatatttgagtattgtataatttacctttcttctgagatctgattaatacagaaggctcagctgggcgcggtggctcacgcctgtaatcccagcacattgggaggccgaggtgggcagatcatgaggtcaagagatcgagaccatcctgaccaatatggtgaaaccccgtctctactaaaaatagaaaaattagctgggcatggtagcacatgcctgtagtcccagctactagccctgcgcccggtcccaggctgaggtaggagacttgcttgaacccgggaggcggaggttgcagtgagctgagatcgcgccactgcattccagcctggtgacagagcgagactctgtctcaaaaaaaaaggaaaaaaatacagaaggctcagagaactctgtatggagatagaacttcttttttttcttttgagatagtattttgctttgtcgcctaggctagagtgcagtggtacgatctcggctcactgcaacctccacctcccagcagttttcctgcctcagcctccagagtatctaggattacaggcacctgctaccatgcctggctaatttttgtattttttattagagacggggtttcaccatgttttggtcaggctggtctcgaactcctgagcccaggtgatccacccgtctaggcctcccaaagtgctgggattacaggcatgagccactgcgcccagtcgagatagaactttttaaaaaatcttttttggggtagatttccagcataagaaaatagaatagtgtgatgaacctccatgacccataaccaacttcaacaatctttggttcatggccagtcatgtagctatgtctggccacttcccccaccctggatgccctggaatattttgaaatgaatcagtgtggtaagagaaggaaatatgttttcttttaataaccatgctgaatcttttatggcaggcccttggtcttaggcgagatgatacattttctgttacaatgcttggtcattgcatcgaaatgtacattggtgattctgaagcttatattggtaagataatcgttattcttattggtattgtactccattttttaggttgtcatatgtctctgtttatgtttctcatattctcgtctgaggttccaagttcatctttctaaccattcgtgctgcattaaaaacaagaaactccatttattttattagaacaatgctgtgggggagttagtgactcaccaagggtgcgttcagtttaaagctgaatacttgctaagtgcaaaataccactatagaatatgtgtaaagcactttgttatagaaggactcatctgtttctataatgggaaaagaaatcttagcaacatttttctgataaacaattgaagaggctctgtcattattttataatgcagggtataacaatataaatctttacatttcaatagaatgttgagatgccatacatttccataacagtgaataagtaatagtataagtttggatggaattgctgtacttgggcactcgtttagttataaacattatgtgataaggaggatgtggtgaggttattgagatctaggataggaaagttgcaagcttgctaactcccgttcctactaaagtaattttttttttttttgagatggagcttcgctcttgttgcccaggctggagtgcaatggcgcaacctctgcccaccgcaacccctgcctccctggttcaagctattctcctacctcagcctcctgagtagcttggattacaggcatgtgctaccacgcctagctaattatgtatttttagtagagactggtcttctccatgttcaggccagactggtcttgaactcctgacctcaggtgatctgcctgcctcggcctctcaaagtgctgggataacaggcatgagccactgcgcccagcccctactaaagtaatttctgatgtaatttcccccaaagtcaaaaagatcaggtaatgtgatacaaaacagagcagagccttagattttgagagggatctgtctgcttatgtgtcttggggttccctgaggaaaacagaggtttctcctaaaacggggtctgtggcaccctctggttttcccaaggagcccgaggctgtcagaaattaccttgggtcctctcatgtggacatccagagtggcgagaagacagactggggaactaatctagccaactgagaagaaaaacaaaaaatgagtaatacccattgtaaagttggataaactgaggcacatcacagtttaaaaatgcatgttcccataggctccacagctcactctcttaaccatcctgtaattgtgcctgctctatgcccagtcactgatgcacttgtgtggtagctcatggcacacctagcaaacagtttccctgcccccttagaacctgggtttcgtttcctgctctacggcagtataaacagtttttctctgcatgtgttgggttctaaccctatatatctcaaattttattaatattactgaatctttttttttttttgagacggagtctcgctctgtcgcccagggtggagtgcagtggcaggatctctgctcactgcaagctccccctcaccggggttcatgccattctcctgcctcagcctcctgagtagctgggactacaggcacccatcaccacgcccggctaatttttttgtatttttagtagtgatggggtttcacagtgttcgccaggatgatcttgatctcctgaccttgtgatccgccctcctcggcctcccaaagtgctgggattacaggcgtgagccaccatgtctggccaatattactgaatcttacagggggctgtgatgtctttaatccttagaaatattaatctatagacaaaggaatacatgaggttaaacagtattcacatttctatatgctttaaaacattcaggcaatgtattaagaaacacacctaagaaactgcagtgaatctactctggatgaaaatttagagaatatctcttcaaaagaagctatctaggccgggcgtggtggcccacgcctgtaatcccagcactttgggaggctaaggcaggcagatcacctgaggtcaggagttcaagaccaacctggtcaacatggtgaaaccctgcccctactaaaaaacaaaacaatacaaaaaaaaactggccaggcatagtggcagacgcctgtagtcccagctactcaggaggctgaggcaggagaatcacttgaacccgggaggcagaggttgcagtgagccaagattgtgccactgcactccagcctgggtgacagccaatctcaaaacaaaaaaaaaagtgctacgtattggtagttatgcatattcttacatatattaacagtattttacatgcttaaaaccttaaaaataattgaaaatgtcaaaattatatgccatatacatttctgtgggcttgaaaatgatacaatataggttgtttctttaaagcagtcactaaaatgtgtaaacttctagatagagtaatcactaaaaaggaaagttcataccaaaagtagtaatactaggaataaaagagggctcaacactgcctttgggagtcctcctcccatgaaacatggctggatttttctccttgtcctgtgtaacctcccttactttatcatagtttactgccttagttactctctcattcctccaaggagagcctcaagaaatttaggtaacaccagagtgtggccccagccagttgccctcagttaccaaggagcaattaggtaggaaatggccactgaaagactgaaaacaagaaaaaaactcaggtccctcacccaaactgggcagtggtggtcaggcttccacacggaaacctttcactgtcaccagagtgtccccagccagagacctgcagttgcctctgtgcttagatgctgtccaccaagggtcccgagttggaaaagggaaaggggggggagttcccctatgtagagcagagggatccccacatggagatagctccagctcatgcctgcaaatgaaggctctctagagagggaaaagggaaaaagaaatgaaaaataaatcccaaaatttgggcttacctcccgactggctcaccaaaatatgttactggtgtggaaggtcttcactacaagttgtccaggttcttggcatggtgaacaaagattgaacaaaacaaagcaatggaacatgaaagcataggtgtattgaagtgaaagtatactccacagagtgagaggggcttgagcaagcagctgatgagccccagttggggtttaagtacccttaggggtttcgtgttggttacaccctatgcaaatgaaggattggtctgtggcagatcagaggctgaagtgaagttacaccctatgcaaatgaagactgtgaccaatcagaggctgaagtgaaggctccctgtctttagaccgtattctgcctcagttaagaagcaaataaaggccctcagggaaatgaaattaaaaccataatgatggtggtgtgtgcctctagtgccagctactcagggggctgaggcaggaggattactggagcccaggagatcaaagctgcagcgatcacgccactgcactccagcctaagcagcagagtgaaaaccctgtctcaaaaaagtaataataataaataaaaccttagtgagaaaccagtacacacccaccagaatggctgaaagtacaggatgtggtgttggtgtgatgtggagcaacttgaactctcatagattcactgctggtgggttataaaagggtaaagcctctttggaaaactgcttaatatcacaataaagttaagcctattatatcagctctctattgctgcctaaccactccaaaacctcaaccaacaacgtgttatttttacaattctgtgggttgagtgacccatttgtgggtcttgtctaggtttactcatgcagctgtggtcagcagatacttgactgggtagatggtctaaaatggtaccattctccagtagggagctcagcttgggtgctgagtctctctctgtggggctttcatcttaggtttctttgtagcacgatgttcccagggttctaaaggacaagaaccacagttcaggacctcttgaaaattcagagttgcacaacatcacttccgtcacgttctgttccatcagtacaagtctcataagctcagagtcaatgtgggagggggctgtaccagggtgagggtgctgggaggtgtgattcattggggtgggtattagggtgatgattgaccatactgattttgtgatgtagcagttctactcccaggtatgagcccagtggaagcaagtgcttctgtccactaaaggtcacaaacaagagtattcatagctttattcattacagcacctaactggaaatgactcaaacgtccaccagtaggagagaggagaaataaattgtggtatgttcatacaatagaatactatattatttgaaagactactgaatcatttagaaacatgcatcagtttcacagatttttttattttttattattttttctgagatggagtttcactcagtcacccaggctggagtgcaggggcgccatctcggcttactgcaacctctgcctcctgggttcaagcaattctcctgcctcagcctcctgagtagctgggattacaggcgcatgccaccacacctagctaattttttgtatttttagtagagatggggtttcaccatgttggccaggctggtctcgaactcctgacctcgggtgatccgcccgcctcagtctccgaaagtgctgggattataggcgtgagccaccacgcccaacaaatttcacagatttttgacaaaaatgtgaatatgtactaattacttccatttataggaagattagtgtattagttcattctcgcattgctgtaaagaaatacctgagcctgggtaatttataagaaaagaaatgtaattggctcacagttctgcaggctatataggaagtatgatgctggcatctgcttggcttccggggaggcctcaggaaacttgaaatcatggcagaaggctaagtggggagccagcacttgacatatccggaacaggagggattgagaaagggaggaggtgctacatactttaaacaaccagaactcactatcacgagaacagcaccaagaggatggtactaaaccattcaggagaaaccacccccatgatccagtcacctcctaccaggccccacctccaacattgaggattacggttcaccctgagatttggtgggacacagatccaaaccatgtcaattagtaatgaacaaaactaattggtagcgatagaaaagtccaagaagtgcttatctcaggcttgggaaagctgacagtattgaccaggagtgggcacagggtcttaaggagctgcatgtgttctgtgccattctggcggtagtcatctgggatgcatgtacatagggttcattcagccatgtgcttaaggggattcacacttgactcttggttttagctcaattttaaaaaacaaatttaagctctggtttctgagagatgctaggttgaagcctcagctctgcccctcggcagccctgtggcaagaaaggcaagtctgagccttagtttcctcatttgttcaagggtgggaagttcataggaagctaaataaaggctagagagttgataatgagtcagagggatgtctccttgacctcgcagaagagatttacctttttttttttttttttttttttttgagacacagtctctctctgtcacccaggctggagtgcagtggtgcaatcctggctcactgcaagctctgcctcccaggttcacgccattctcctgcctcagcctcccaagtagctgggactacaggcgcccgccactatgcccggctaattttttgtatttttagtagagacggggtttcaccacattagccaggatggtctcgatctcctgacctcgtgatccacccgcctcggcctcccaaagtgctgggattacaggcgtgagccatcgcgcccggccaagatttaccattcatgtcatttttatttttagaaagtttgcatgtcattatctgccaaactacctatttctgaaagctattggtttgaactgtgtaaaactcattttgtttatgtcgaatgattgtacctaatacatctgttcagatctgttcaaatctatattacccttaaggttttaatatatgggaaatggattttatttcatcgtggcttttttatgcataagattggtgactatacccaatgggcacagcacagttctttttttttgagatggaatctcactctgttgcccaggctggagtgcagtggcactatctcggctcactgcaagctccatctcctgggttcatgccattctcctgcctcagcctcctgagtagctgggactacaggcacccgccaccatgcccggctaatttttttgtatttttttttttagtagagactgggtttcaccgtgttagccaggatggtctcgatctcctgaccttgtgatctgcccgcctcggcctcccaaagtgctgggattataggtgtgagccaccgcgcctggccacacagtgcagttcttacctgtaacagctgaggagaaagttgtccacaggcctcatacgtatttaggaggccttggaaatgggcaactgttgaaacactggagctgcaactgcatgtgcttctgaaagtcttctgacacttcctttgcaaatggtggaaaacaaatgaaaaagaagattggaatgttgttttccttctgctctcaacttgtgctcttaaaagtataatttgacttaaatgatagagatggtgtataatgatggaaatgataaatgatggagttttgtattttattctaaatagtataatctgacttaaatgataagagatggtgttatataacaatagaaatgataagtgatggaatttcttattttattctaattatagtatttctttttaggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatc

SEQ ID NO: 37295 - DNA, 23327 bp, Homo sapiens
gccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggtgagtcaccgcacccgcccagagtcgccatgcccgagccacagatcgtccccctccccactctgtgggcctcctcatttctctgttttctagccccaccaagacctagactgcccacagacatcccacatcccaacctggagccttgcctcatctggcttgcgtctgaagctgcacttcccggccctgagaccagtattttgctttagggatgagttggaaagcaaggttcttgtcttggcagcgaaccatctccttcttctgggcctttcccccaacttgcatccttgatccagccccagggcctctggctcccctgcttcttccaagggctgaattccccaagggagggagactgtctgtctctgcttagaatgggaggagatggaaaggacatagaagttgagggtgccatgagagggatgcatgcagggcagactccagaaataacttcctgctagagcattgccatggatggaatgagggcagcagggcactggaaggccaggagagagcttccacttctgtggcttaagaccacgggaagattgggagaggatctgcaggtctgccaacctgcagtaggtggcttggtgatagagagtggcagcaaactgaaccctcaaagtactagtagcagtagtagtagccgcagcagctgtagcagtgagagagatccaggaaggatgctggccaggctgctccccttcctcctccttagcaaatttccaactccaggaatctcagcagctgggaagggccaggaggagtaaggggtggaggacaattctaattttttctaatcagttcaggacccatgggagatggatatacttttgtgaggggcctgtgactggtcatgttgcctgtatccttggctcttgctacatgtctgattgtaaaaagggaggccagaggtgaagaaagcttctcacctgctcctgctagggggcttttctctcttcaaccagtgcctaagccacattaagtatccattactgggatcaatgctgtccactgggactgtcttctgcctctactgtcggtctgggggcagggggcagggacaagagctcatttctcctcacttgcttggggagtgggggcctagctctaatctttcttcttccattatccctatcatctggtagcagggtcggtggtccccaaaactttgggagagatagaaagcaacggacttcatctcctcttctgtttaccatctgcttcctcattcacctttgctccctccctcccttcctccctccttctccatctgtcagagttcgaggactggaggcctttttaggacatgctgaactctctaagctatttccaggcaaattctaggttatttttaatagcttggtctcttgtcatttccccctcctctctgaaggtggcccctggttccgtctcccagagccaagctggggcctttcccagagggcctgactgcctcaccctgcttttgctccagcagggggtgctctgctgctggggggcggggggtatgtgagaggccaggcacctgctcagtccctagcttttgagttgcaggtggcctgccttagcactcactgatgaaaaaaacttcttgcctgttttgatgtcttttagtctagctctgggatgagactttaaggtctaacctttgctgtgtggttccagcctcatttacttccctcaactgtaaaaaggatataaacatagtattactacatagggttgttgtgcagattaagagttcttaatatatataaaatgcttagaatagtgcatagcccgcagtgagtgctgtgaagtgttagtagtattgctattcttgtattgtgattcacagagcgccttacagagattctggatccaaaggcttggctagagggcctccctggctgagccagccttccaggccaagcatcctccccagagggccacccagattgagaggggccaaagaggggctggacttgggctggggccctggagtgtgtggagaatcgagaagtgcagtggtcgtgggctactcctttgtcttcacttagctgagctcccagggggtccctctgccccccagctgccaacacttttttttttttttttttgcttttctctctgcagtggctacactgtggctgtccagaagactggggtggttagggcgtatggcatgaagccaggaaggagtgtgtgtggctggaccagaggtggagggactagagaggatgctgctgggtgctcttgttccactaaggatcgattggtctcttctccaccaagagcggactgggcatatctatgcactcagcttctttcttccacatgggcccctcccctcctccctacttttggcctccagaggagatgtgaacatagaacaaggataacttatctgggtgcttagctatgcactgaccagctgtgacactgggtatctctatgagtccacaaaatgtgtgtgttcagtaaacacattctgacactccctatggggcaagcacaaagatgaaaagacagccccgacactcagagagatggccacttctatgtttggaggctgggggtactgctgacttgcctgaaggttgccatttatttatgcagggctgtatcaccccgtttccttttctgcccagggtaccctcatctccccactctctccttccctttctggggtggtctcagtgttctagagacaggtcagtcactgggtggagtgacaaagtgttggagttaggcccatgtggatttgaattccagcatcactgcttaatgtctttgagtgagttttctcatctgaaagacaagaaaagaatccttatctcataggattgttctgatgattaaatgacataatgcatgtgacttgcctatcctggtgcttggcacatatgtggacagtgatgaatgttagtttcttatatccctggtgtctagcctcggatctgacgtcatagtaggtgctgaataaatatgatttccttgtctcaccagcgcctgacacagggcttggcatacaatagactctcaataagtagttgaatgccaaatgtgtcttctcttctctactactccctataccccttctctgtcttgacactggctctgacaagggatggcagctgctaagagatgaggaggagttgtgggaaggaagaatggctctctgccctccccctccaccccatcagagctggcacagtgccccacagatgcctgtctgtaatactgcctaacatggttttgggccttgccccccaggaagggagatggaggagaagagtgtgggagagaggcgttgaggtttgtcccactgccacttctgagtctctccttctgcaaagagaggacccatggagccagctgggtgtcagtcatcttacctcacccccgccttcactctggcttgggggttcagccccaggggacccaggcagcctccattcccagcactgtgctcccctggggaagacggcttggctgtgatcatggaaaattgtcctgccaagaaagttgtagctgggaaagaggctgagggggaggcaggagagaagactgggtgggggtggaagggaaggagaaatcatggacatggggagaaggaaggatggggaaggggattcaggatgtcgggaagagaatggggtagcattggaggcagaaggagaaacttgtccctacctccatgccagccagagtgactgatggaatcctgggctggcacagcttctgggaggtggggtctttgctgggtccctgatgagggggcagtgggtccgtatctagcctcttgcctggcctctgaagctggtccctgagccacactctgatgccagtctggggccctgttacttttgctcccagcattcttggcatttctggctgggtttcaactggactgggttggggagcagggcagagcttggggatggggccaaggaggggatagggaaggcctactcaggaacaggtgctgggaacaggcagttctttcaaaccagcactgttggcctggctgcttgggttggcgtgtatgtgtgtgtgtgtgtgtgtgtgtgtatctactgtgtatgttgatcccttatccagatagtatgtacatgcaacgtgatgactgcatgaccaagcatattaatttgtccttgccagggtttgagaaaactgacatttgccccttctctttagtccttgaacactctctttagtactgaggggttgggcctgggcagctctaatgagattgggtcattctgacctctaactcctgtccctgtccctgcccctgccccatcttgcaggctgctggtgggtgctccccaggccctggctcttcctgggcagcaggcgaatcgcactggaggcctcttcgcttgcccgttgagcctggaggagactgactgctacagagtggacatcgaccagggaggtgtggccctgcatgaacagagtgggggaagcgtgtgagcggggaggagaggacttgggctcctcttccctcccctaattcccagtgtcctgcctctagctgatatgcaaaaggaaagcaaggagaaccagtggttgggagtcagtgttcggagccaggggcctgggggcaagattgttgtgagtattgcttctcatgactgaatgcacggatggggtgtgtgtgtgtgtgtgtttatggtgtgtgcatacgcataggtgtgcttagagaacacaagttaggaatatggtatgattccaagtacatcagggagatataaaaaggtgtgagacatggtccttgtccttataaatgtaaaaatgtctgtccattcattcatccatccatttgtcaaactcttactgagaaccttttaagcatcaggcattgtgctagttactacaggggaaggctcatgcctgtaatcccagcactttcggaggccgaggcaggtggatcacctgaggtcaggagttcgagaccagccggaccaacatggcgaaaccctgtctctcctaaaaatacaaaaaaattagccgggcgtggccgggtgcggtggctcacgcttgtaatcccagcactttgggaggccgaggtgggtggatcacgaggtaaggagatcgagaccatggtgaaaccccgtctctactaaaaacacaaaaaattagccgggcgtggtggcgggcgcctgtagtcccagctactcagagaggctgaggcaggagaatggcgtgaaccggagaggcggagcttgcagtgagctgagatcgcgccactgcgctccagcctgggtgacagagcgagactccgtctcaaaaaaaaaaaaaaattagctaggtgtggtggcaggcgcctgtaatcccaggtactcgggaggctgaggtaggagaatcacttgaacctgggtggaggaggttgcagtgagctgagatcgcaccattgtaccctagcctgggagacaagagcaaagttccgtctcaaaaccaaccaaacaaacaaacgaaaaaaccagagctctctgtttctctctctctctctatctttcagtaacacgcatagatacacaattaccaatacagatcactgtggggcagaatctggttcatgttaagtgagtggtctagtctccagtctataaaagtccaaaggaggagtagagagaagacttctgcagaggggatgatttgagccaggctttaataataggtaatacctagcctgtgcaacatagtgggacctcatctttataaaaaataaaaacaaattagccagtcatggtggtgcatgcctgtagtcccagctacacaggaggctgaggtgggaggatcacttgagccctggaggtcgaggctgcagtgagccatgattgtgccactgcactccagcctgggtgacagagtgagaccttgcttcaaaaaaaaaaaaaaagtaatacttggagagtgaagcggacaggaagttctttgcagatgagatggtgacacttacaaaggtccagggacagggccaagcttggcattttggaggactgtgacatgatcagggagacacacatcctatgtggtggcttaattgtgtcttttggctccaggcagaatgtggaacaaggagatctccatttgagggcaaggaagtgggtgcagacaggttgctgggttatgcatggacctgtgtaacactggcagggtaatggtgcttgagtggtgccggcataggggtgtgtgtgtatgtgtgcatgtgcatgtgcatgtgagcacacatgtatcagtatctgccaaatctctgcatatgggcagcatgcctcaagcaggtccctggcccacagagtgaaatgatccccatcccttcctcccccagacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggtgagtcactcctcgggaaggggagaaggggaccaaaacctcctcttacctcagagacagggttggggatggcacatggccaagcatgaccacatgtgcactgctgtatggccccagggcactgccatgccttccaccccattgagctagtgcacacatgaatggggggtgcctcctttccctcgcacggccaagtgttcctcaacatgctggcatgggccccaagtgcacgctgggcctgcagctggggcctgcatgctccaacacactagcccacacctcatcactgccattcccgtctccgcacgctgctgctggctgagctgacactcggtgagtgtgatgccacatctgggggaccccaggaagcctgggttggggacagggtggggagagggctagaaagaagaggcagggcttccccgtgtgcctgtctaactcagtgtccggcctgaggggtgttccttgcgccctgccctgggcactaacaggtctgtccttgcaggcacggccagggtggagctctgtgcacagggctcagcggacctggcacacctggacgacggtccctacgaggcggggggagagaaggagcaggacccccgcctcatcccggtccctgccaacagctactttggtagggacctctccccggcccagaactgctctaaccctctgctcctctctcttgtcctctctctccatgctcccatccttctgtctctgtttctgtctctcaccttgtctctctctgtctttctgtctctggctgtgatctctctggtctctttttctctctccacctcttcttcttccaccattttctggcctttctgtggctctgtctccctactctgtggcccctactctggatgtcccctccctggtgtctcaccccaccccccacagggttgctttttgtgaccaacattgatagctcagaccccgaccagctggtgtataaaactttggaccctgctgaccggctcccaggaccagccggagacttggccctcaatagctacttaggtttgtaagctcccacctcctggactctaggggcatggcccagcctcccctccttccccagggaactcgacctttggtgccttataatctcctcctcccccaacacacacccagggagacatacattgggcccaaattgcagagaagagctgggtccaatgatcaggcctaagaggaggaggcccccagggtggtggcctctggggctgtgagccaggggtctccatggaggaagattcaggtggaatgagagggccagggctgaggatattttgggaaggacagtcctgtcttctagggggactttccctgaggggatggatggtgggcacatattgaagaaagggctaatgttgttggtaagtccctctcgttgtctcatctgcattcctctgcagaggaggaggaaaccaggcctgggagatgtttgggtgaagcaggcgctctctcactcccccttgtctccccctcatccatgtgaagacttcccctccctgccaggatgagggagttgggggaaagaggtgcactgggtgggattcgggcctgagagggacctctagctcttctagctccctgggtgtgggcagggtgaggccactgtgctcagcctcctacctgggctcctggccttctcagccatcacctttctctctcttgcccagtccctgaggctgacctcactgcactttttgtgccaagcttgtctctgggcctggtgggtgtgggaggctgccaggccctgtggggaggaagagctatccagctgtggtgctgatgacttggggggacctatcttttggctcttaacctaggggagggggcagggtgcaggggagctgtgacttggctcttaacctgtagggagggggcaggggctgggggagctgtgacacaccccagcttctgagtcttggggtgaagacttaggggtaagtcacccttcccccaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatgggtgagtgggtagagggccgtgccacctgagggaggctgggtctagtagccccagtctggctgaggccacttagcctcctgctggctcctctggccagggaggacccacactgaatgtttccctctctccatagctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccaggtgtgacggggaactggaaaggctcagggagggaggggccacaggagggatggggaagcccctcagaggtcagggtgtggtcttctgaggactcagggagagagggtccctgagcttatgtctgagctgtaccatttaccagctttctgaccttggcaagttcctaacctttttgcgttagtaatatctgcagggagtggccaagaggattaaagatgatgtatgtagagtgcctgggattttgtagcctctcaataaaatagaaaacatacctgagtgactggggggagttgaggcctggatcttgtctgcaaggcccccagccagcgtgactgccttttccctgtgccctgcagatattgcagtgggtgccccctttgatggtgatgggaaagtcttcatctaccatgggagcagcctgggggttgtcgccaaaccttcacaggtgaggggagtcgctgggatgagggaatgggtgtgggtggaatcagcagaggcatcaggggaggcagaggcctgcgggaggtgggattgagggaggctgacagctggttctctaggtgctggagggcgaggctgtgggcatcaagagcttcggctactccctgtcaggcagcttggatatggatgggaaccaataccctgacctgctggtgggctccctggctgacaccgcagtgctcttcaggtgagcccctctcaaccttttccctccctgaggccgtcagcccctccctgtgactctgaccccgacctcagtgccaaatctaatgctgaagagtgtttcccagcctcatgttctcatgtttcttgtgctcttgactccccaatcccagggccagacccatcctccatgtctcccatgaggtctctattgctccacgaagcatcgacctggagcagcccaactgtgctggcggccactcggtctggtgaggtgggatcgggtggcacctggaccctggcagcttcccctgccctccctttgatcctttatctccccagtttggggctggggctgtgacaggatgtgacagatggggtgggggtaggggccttggcccatcagcctcgtttggctcaggagccacctttgcccccgcagtgtggacctaagggtctgtttcagctacattgcagtccccagcagctatagccctactgtgggtgagtgcggtcccccctctgtggctcgcccttttgggtttcccagggaggggggtcacttcgaggtggtagaagagcacccttggaatggggtgagctggagcagctctgcagctcagcagctcctcctttcccaacatgccacagccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggtggacactgaccccttggcttctgagggtcattttcatggctccatctcttttccctgattcctcttagctgctttttcccgagcacactcgtgcctccttctaagacctagacacgtgggaaacctgtcttctgagctcacttcctcctcatctgctgccctctcctgtcatttctgcactccctggaggaggaggaggtgcaaggggcttcatgtcccctcttccagctgaatggaggaggtggcagcttttatcatcacatctggtcctcaaagccctaaaggtttcccctgtcccctaccccagtctttctccctcctccttgctcagttctccacctctctcattcatctccctaatattctttccaagttttagaattggtcctaggtctggctggggcactgagcagggctgaggcctggggattgttccagtgaggaatagaccttcctcttcctaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagaggtgagcatgggttctggtttagcccagggggaggagctgggagggcaaagatcatggtccctccccagtgacaccaattcacagctcacagagccctttcacgtatgctactccagtaattcctcatatctctaggtgcctaaatgaccatgttcctagtcaaggggacagagctcctctactccatgtagtcattcagggggctcaggttgatgggattctgtaatcttcaaatgcggccttcaagctcttgaagtcacattcatcccattcagctggaagggagaacatgaggccccttgcttgcatggtttttatggctggcccagaagtggtgcccttgacatcttttcccgttctaaatccggaactcagttacatgcatgtgagctggggcagtgtggcccagctcttgacttgctgctagtctctaccatggcatggtagtgctcccatcactaccatgatgagaggacccagaggagaggacccagttcaggatcacatggctaataagcagcagatctgagagttgaggacaggttgtttaatcctgtgatactctaacccaccatatgccatggtgacaggtttgccccctgccttgccccctaggaatgccccttatctcatgtctctccccagatccacttcctgaagcaaggctgtggtgaagacaagatctgccagagcaatctgcagctggtccgcgcccgcttctgtacccgggtcagcgacacggaattccaacctctgcccatgtgaggggggcagagagcagggtgggggtgggagggcaagagttcaaggattgagagaaagccctctcaggaggaccagtcagagggaagggctgagcctgcagaaaaggcagaaggtggaagaggacctgccgatggacttggagactgagatgagggtcagtgatggggccacgggggctcccatggcaaggaatagcaatccttcacagtacactaataatatgcagtctacatacatctcattggttagtcttcaaacctctgtgaggtaggaattatattagtctcattttatagatggagaactgaagcctagagaggttaagttacttggccaaggtaagtaatggtggagctgagatgagaacggaggtcccctgactcccagtcgtgtgtacagaggcctgaggcttggacgggtgtgatggggacctggggtgggaagagaggctcagggagtgaaggcaggtactgggggagcagactgggcgggggaatggtagggggaggtgttcagaacttagcaggagtggggtctgactctccagggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggtgaggacctgggggcaggatggggtggggtcttgaggggctccagtaacccagactgaccttgccttctctcccattccaggagaagccactctgcctgtccaatgagaatgcctcccatgttgagtgtgagctggggaaccccatgaagagaggtgcccaggttggcacatctgcccttatccctacgtgagtagcctctccataagcccgtagaccacccctgactctaatctctttccacccttggcctaggtcaccttctacctcatccttagcacctccgggatcagcattgagaccacggaactggaggtagagctgctgttggccacgtaagccaggcggggccggaagggtgaggtgggggtagtcatattgacctcatctgaccccttgggaggtgcctgtgcctgatgcccatacttgcccctgcccactcaccaggatcagtgagcaggagctgcatccagtctctgcacgagcccgtgtcttcattgagctgccactgtccattgcagggtgagcctggcccaagggggcacctccattggagggagggggcattgacatttccaaaccttggccagggccctgccttcattgagccaggccccagaccttctcacccctgttctgacctctccacgccagaatggccattccccagcaactcttcttctctggtgtggtgaggggcgagagagccatgcagtctgagcgggatgtgggcagcaaggtcaagtatgaggtcacggtaagtgtcagggatgaggcccctccatggtcaccctccctccttggcacagaggagaggctgagctgtgtccccagggctggggctcttctaccatgtggcagcatgcagtttgaggcctctgtcctgcatatggaccttggctgtgggaaggtgttcctgctggggcctcatttgaccatttcctggtcattctgtctggctgtctcacctgctggtgtggtaggccatgagagtccagggaagcttctctgctgtgggcctcagctgggggatgggaacatggggcggggggttaatgtctctccctagaactctgcctttgcttggctggggcctctcctcacaccttccagggacacttccagggtttcccggatttggtgggtggagagaatggtgcctggtggggtctaggatcctgagtatttgttgaaattgtgtttcctgagggccttctcttcagcccttgttccttccatctctgtggatttaggatccacttgaaagctgagttccttggctgggcacggtggctcatgcctgtaatcacagcactacaggaggccaaggtggcaggatcacttgagcccaggagttagagacaagcctgggcaacatagatcctgtctctacaaaaaattaaaaaaaaaaaaaaaagaaaaactgaggtctctcccctcatactctctttttcccacaggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggtgaggcttaggtgggggtgggggttagatgtggggacagatgttatggggagtaagggtagtgagtgcagtgatggggcaggaggaaggcggtggggaggagattcgatcttagcactgctgtgattggagggacactcactaagaccccccttccgtgtccaggatgtggacagtagggataggaggcggcgggagctggagccacctgagcagcaggagcctggtgagcggcaggagcccagcatgtcctggtggccagtgtcctctgctgagaagaagaaaaacatcaccctggtgagggcaggccagactcggtgcagccagagctccggggtgctgcgtgtccaggaagggtacctgttgagacacatgatggtctgggtgcaagttgaccagatgttcccatcacaattcataggagggggtgcccgggaggcagctactgacactgcagacccccttcctgctcagcccctgcaattgctcactctagaacaggtcactccacctgaagccagttagttagccaagcaattgattcacattacgtttatataaagcattacattttatacgtgatgggatggggttagcccatcctcacactttgaggtctgtttgtcgttcttttgaactcttataagataaaaaagtcaatttgtgtaaggacacttgcttgatttttacagtattaaaaatgttaagttcttttttgttgttgttgagacggagtcttgctctgtcaccaaggctagagtgcagtggcacgatctcagctcactgcaacctctgcctctggttcaagcgattctccttcctcagcctcctaagtagctgggactacaggtgcatgccaccacacccggctgatttttgtatttttagtagagacggggtttcaccatgttggccaggctggctggtctcgaactcctaacctcgagcgatctgtctgcctcggcctcccaaagtgctgggattataggcctgagccacgcgctcagcaaaaacactaaattctaaaagttctaataattaagacaaccgtatattatatgtgatttattaagtttaccccttttgagcagttttgctttccccttttctgcttgttttgcagagttgtgttgtttaggtgaaggtattgagcagatccgcacatgctctgtgcccctccctgctaggatggggctcgcagtgagaatgtggtggggacttagattaggaggtctttggcttgattgtaaggaggtggaggtaaaccccaggtagagccaaggagaccctttgcaggggaatgtcagcagctgctgcagtccctgctttgggccctcagctcccctgggagcatggcatgaggcaaactgaagaacgtcaggggatgtaggaacccatgtcgtggctgttgctctattacatggataatcctcccttctccacgtgaccgatttcctctgagaggcctcccttttaaatgggaactttgaaatagattctttttgttttcatgttaaaatgtatttatttatttaaatgacaaaaattatatttatcatgtataatacaatgttttgaaatatgtatatactgtggaatggctatattgagctaattaacatatgcatcacctcacatacttatttttgtggtaagaacacttaaaatctattctcttagtgattctcaggaatacaatatgttgttattaactacagtccccatgttgtgcattagatctcttaaatagatatctcttccttctgtctaactgaaactttgtatcttttgaccaccatctcctccatctccccagccacaccccgcctccactccagccctaggtaacaactattctactctctacttctatgagttcaactttcagattccacatataagtgagataatgcagtatttatctttctgaatctggcttactttgcttaacataatgtctaaagtagattcttttttattttattttatttttttattttttattttttaattttattattattatactttaagttttagggtacatgtgcacaatgtgcaggttagttacatatgtatacatgtgccatgctggtgtgctgcacccattaactcgtcatttagcattaggtatatctcctaaagctatccctccccactgcccccaccccacaacagtccccagagtgtgatgttccccttcctgtgtccatgtgttctcattgttcaattcccacctatgagtgagaatatgcggtgtttggttttttgttcttgtgatagtttagtgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaaggtttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtatctgttcatgtcctttgcccactttttgatggggttgtttgttttgttcttgtaaatttgtttgagttcattgtagattctggatattagccctttgtcagatgagtaggttgcgaaaattttctcccattttgtaggttgcctgttcactccgatgatagtttcttttgctgtgcagaagctctttagtttaattagatcccatttgtcaattttggcttttgttgccattgcttttggtgttttagacatgaagtccttgcccatgcctatgtcctgaatggtaattcctaggttttcttctagggtttttatggtttatgtctaacatttaagtctttaatctatcttgaattaatttttgtataaggtgttaggaagggatccagtttcagctttctacatatggctagccagttttcccagcaccatttattaaatagggaatcctttccccactggttgtttttctcaggtttgtcaaagatcagatagttgtagatatgtggcgttatttctgagggctctgttctgttccattgatctatatctctgttttggtactagtactaaagtagattcttttactaaaaaggcagaaggccttgcttttagacagcttggctaaggattcttgaatggctcaaaagtggcaaaataaaagataactcaaataattcagacactcttaaagccattcttctgtgtctggatcgtggtgtgatgaatataacataactttcaggcaaatgggtcgtgaggtggtgattgggccaaatggatttaggtcagtcctggaaagaacagagcctgagtcccctgtctacccaggagctcctgaggctacctcctcctccttcagcgagtttgggtttagggcaggggtgtggctttgccgaatatggacctgagttcaaatatttgctccaccactcattagctttgctagtgctgtgacctgaggcaggtcgcttggcctccttgggcctcctcagtttcttcctttgaaaaatgaggatgataatgtgcaccttgtaggactattgcgaagcttaagtgagataagtgcctgacaagtagtaggtgctcaataaatgggactgtcattaggtaacataagcatcacttggggaagctactctgcctgtgctgtcaagtaagagattcccttccatgctgccccctccacgcatttcaaagctgaatagctcagatttggggcaggcagctattttggatataagattagtttgagaagacttcctggaggaggggagtttgaggtcaagtaaggaaaatgggagagatggcagtctcagcagggttgagctgagtggcttagacccctgtctgtccttatccctaggactgcgcccggggcacggccaactgtgtggtgttcagctgcccactctacagctttgaccgcgcggctgtgctgcatgtctggggccgtctctggaacagcacctttctggaggtgaggataccactcggctctagtctgtgtttcttcttcctccaaagcccctccaggactcatttctcctcctccttcctcactgtccaaatgcagcatccccccccttttttttttttttgagacggagtcttcctttgtcccccaggctggagtgcagtggtgcgatctcagctcactgcaacctctgcctcccaggttcaagaggttctcctgcctcagcctcctgagtagctgagattacaggcacgtgccaccacacccgatatttttgtatttttcatagagacggggttttgccatgttggccaggctgatctcaaactcctgacctcaggtgatccaccctccttggcctcccaaagtgctgggattacaggtgtgagccactgtgcccagcccaaacgcagcatactcttaacccaaaccaggcagaaacatcctctgtgttgggcaccattacatttataatttcaggaggtaaggggaagggagggagacatggggcatttaggagaagggtctccttccctgttcccttaggagtactcagctgtgaagtccctggaagtgattgtccgggccaacatcacagtgaagtcctccataaagaacttgatgctccgagatgcctccacagtggtgagctgcagggttgggggataggtggggaggactctcttctttcctgctccctccagttcttgttccattgacctcttgctccattgaccccttgctccccagatcccagtgatggtatacttggaccccatggctgtggtggcagaaggagtgccctggtgggtcatcctcctggctgtactggctgggctgctggtgctagcactgctggtgctgctcctgtggaaggtgaggcttggaggtggggctgatgggggtggacttcctggttgggtgagcagcattttgtattgtggttctgtcacccacccacacactcatgtattcagcaaatctgcactgaacacttgccctgcatgtctcaggaactctattagtccctggatgtttcaaagataaatcagatgcaggctgggtgcagtggctcatgcctggaatctcagcactttgggaggcctaggcaggtggatcacttgaggtcaggagttcgagaccagcctggacaacatggtgaaaccccatctctacttaaaatacaaaattagctgggcgtggtggcacgcacctgtagatccagctacttgggaggctgaggcaggagaatcgattgaactcgaaaggtggggttgcagtgagccgagatggcgccattgcactccagcctgggtgacagagcgagactccatctcaaaaaaaaaaaaaaaaaaaaaagccgggcatggtggctcatgcctgtaatcccagcactttgggaggctgaggtgagtggatcacctgaggtcaggagttcaagaccaagctggccaacatggtgaaatcctgtctctgttaaaaatacaaacaaataaaaaaaattagctgggcatggtggggggtgcctgtaatcccagctacttgggaggctgagacaggagaatcgcttgaacccgggaggtggaggttgcagtgagccaagattgcgccactgcactgcaacctgggggactgagcaggactctgtctcaaaaaaaaaaaaaaaaaaaaaaaaaagaaatcagatgcagatctcgttctcagggattttatagtccagtgggatgggagtggtgagcctgtagtcaaggacaaggcaggaagtgttgagttgagaaaatggagtgggagtttagagggaaaaaagcttgagaggaggtagcactggaaccagtcctcagaggaaggtggggtagtagggtgaggatgtaaggggatgaggtaggtggggtccagcaggaccatggtaggcaaagtcgtggaggcagagaagtgtgatctgacttaactagaatgtggcagtgaaaactggaaaggtaaatgtggccaagaaggccaacaagcacggagaacggcctccaggggactgccctcatggcggaactcagagcttccacataccaggctctgcatggaagcattcttgtacacccagagctgtataccgaatcatactggtatccagggctcaatgtaaaagtatgcacatgcacacgtcagtacacggaatcacatacatcaccggggtcatatgctgagccatctgccacatcgggggctatgttcagaaccacacatgtccttggggctctggagaactgcccctgcctgtgcctgctctttgggaccaatcagagactgagccaccctttggcaagtgtgaatcatcagtagaccaggctctggagtggcatccaagctgttgggaaccttcccagtcttaggggagattgatgcctctgtgaaactggtcccaggatgcttgctccctgctcccatggaaggaagacagagcagagataggggatcctgtccttcctcaatctttccatcctctgcttcctctgccctgcttctccctcgacatcctagtgtggcttcttccatcggagcagccagagctcatcttttcccaccaactatcaccgggcctgtctggctgtgcagccttcagccatggaagttgggggtccagggactgtggggtaactgttgtgtgtgtgcatgtgtctagtgtgtgtgggtatgtatgtgtgtgaatataaggagaattcccagcattcaggggatcaggaatgttcagggtgaaaaatgagattgcatgagagtgatgtgaggtgagaggtaattagaagggtgcagatataagggtaagtctacacagcctgaggcgtgcacaaagggttggtgggctcatggggtgtgagcatgtgggagtgtggggaggtcgcatgcatgcttttttctatgggcatgagtgtgcaaggagatgaatgtgtaaggagatgccatgcagtctgagcatgtaggagtcctgggcctctgagtgtgagtgtgcaggggcacattcccaccctggtgtgtaagggccagcatggtcctcatttagggtggggctagactactgtattgatggacaagagggtattgctgtaaggggcgtgccgcccaaggtacaagtacacggggtgcatgtttatgaggcttgagaggtatcattccagagatgcaggggactaggaagccattttcttcctcaggtcttgtttgtgttctgggggacactattgggtctcttaagaagctagagggggtacaaatcttgagtccggtcctgatgctccaccctcaaggccctctttcaggggccaagggagatacccttggtcctgcctcttggacgcccttctggtctctctcttgctgtgaatgagaacctggggacacagcactgatgggagcaccgtgggtgctgcccaccacaccagatgctattcagcctatttcctttctgccgcagcagggatggtgagggtgaggagctgtgccgcgctaggcatctgctccagggaccgcagctcttcaggctcctcatggtctggcctggtgtccttatagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 37296 - DNA, 3198 bp, Homo sapiens
gtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagtaagtagaattcatagctgacttctgggaagggaagggccactgttcctggggaggaagggcagtgggacttccgggaacaggcctggctggttgagggaattctgtgctggagcgatgagtgaggtggagcaggtaggtatggccagggcacacagaattcctggtttgtctttccttctctgggtgctccatttggctgcctctcaggaggtgtaagggaaggagggaggactgccagaggagtggcaaagcatggcctctgatccaggaagaggccaggaagagaggataggtgtggggtcagcttgttgcagagcaagaaggggctcacagtttggcagcacctccttgggtgatgggctgctggtattcctcaacccttaaggattggtatggctggtttcttcttgcctcagccccatgaggcctcctcttctcattccaggcctgttctcctggcacccggtgcttatgtctttggctgtaagtagtgggcctgggcagttcttaggggtgggagcatgggcatggttggtggccctggcagcctctgaatctttgtccacatttaatatctgtttggaagagttgcatgctccaactactcctgcccatggtatatatttcagacttgaggctgggcacggtggctcatgcctgtaatcccagcacttagaggccgaggcgggcacatcacctgaggtcaggagatcgagaccatcttggccaacatggtgaaaccccgtctctactaaaaatacaaaaaattagccgggcatggtggcacgcgcctgtagtcccagctactcgggaggctgaggcaggagaatcgcatgaacccaggagacggaggttgcagtgagccaagattgcgccactgcactctaacctctaacctaggcgacagagcgaggctctgtcccaaaaaaaaaaaaaaacccaaaaacaaaaaaaccccccaaaaaaccaaaaattagctgggtgtggtggcaggtgcctgtaatcccagttactcaggagcctgaggcaggagaattgcttgaacccggaaggcggagattgcagtgagccgagatcaggccactgcactccagcctgggtgacagagagagactatctccaaaaaaaaaaaaaaaaaaaaaaagagacttgaatcagagtaatgaagacccaggacccaggtcaaatgggtaagatttgtctaagcacaatgaggcttcacccacctctaggcagaaagctgagacattgcatttggatgtacctctgtccctttttactttaatttctggtgatgcacctaactttccctgaaacagtgcacccatgtggccagctcttgccaagaaattgtatccagccccacgttagggaaacaaagcttgtgaatcatttataactgccacatctcaaaccctgtgtttgcttggtaacatacgacagatgacatttcagactggcacctaggaggaagtgtggagattattcagggcacatatatcatcccagatggggttttccactcttgccccaccaaatggatagtcttgtcagtggggagagaaagaaaaaggggaatcagcccagactcactggcagctaagggttacataaagccctcttctcctcttctggggcagcaccctcacttgagcttcccatcccctgtttcctcagttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgt
